United States Patent 11,931,406 (FLAVIVIRUS VACCINE) - sequence listing, part 18

SEQ ID NO: 8588 - RNA, 9879 nt, Artificial Sequence
  derived and/or modified CDS sequence (opt1) from DENV-1__FJ898416__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugacgauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaagaccucccaggaggggccgcugcccgagaucgaggacgagguguuccggaagcgcaaccucaccaucauggaccugcaccccggcagcgggaagacgcggcgcuaccugccggccaucguccgggaggcgaucaagcgcaagcuccggacccugauccuggcccccacccgcgugguggccuccgagauggccgaggcccucaagggcaugcccauccgcuaccagaccacggcggucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggacggaggcgaagaugcugcuggacaacaucaacacccccgagggcaucauccccgcccucuucgagccggagcgggagaaguccgccgccaucgacggggaguaccgccugcgcggcgaggcccggaagaccuucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacaccaucgagacccucaugcugcuggcgcucaucgccgugcugaccggcggggugacgcuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggccguggagaaccaccaccacgcgaccaugcuggacgucgaccuccaccccgccuccgccuggacccuguacgccguggccacgaccaucaucaccccgaugaugcgccacaccaucgagaacacgaccgcgaacaucagccugaccgccaucgccaaccaggccgccauccucauggggcuggacaagggcuggcccaucuccaagauggacaucggcgugccccugcucgcgcuggggugcuacagccaggucaacccccugacccucacggccgccgugcugaugcugguggcccacuacgcgaucaucggcccggggcuccaggccaaggccacccgggaggcccagaagcgcaccgccgcgggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggagggguccccgggcaaguucuggaacaccacgaucgcggugagcauggccaacaucuuccggggguccuaccucgccggcgccggccuggccuucagccugaugaagucccucgggggcgggcgccggggcaccggggcgcagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgccaagcugcgcugguucguggagcggaaccuggugaagcccgaggggaaggucaucgaccucggcugcggccgcgggggcuggagcuacuacugcgcggggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacgcuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggccggcacccgccacguggcggucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgccaugaccgacacgacccccuucggccagcagcgcgucuucaaggagaagguggacacccggaccccgaaggcgaagcgcgggacggcccagaucauggaggugaccgcccgguggcuguggggcuuccugucccgcaacaagaagccccggaucugcacccgcgaggaguucacccggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgccacgugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacccgcaucaccgaggacgaccugcagaacgaggccaagaucacggacaucauggagccggagcacgcccugcucgccaccuccaucuucaagcugaccuaccagaacaagguggugcggguccagcgccccgccaagaacgggaccgugauggacgugaucagccgccgggaccagcgcggcuccgggcaggucggcacguacggccugaacaccuucaccaacauggaggcgcagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccacggcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcccagauguggcagcugauguacuuccaccgccgggaccugcgccucgcggccaacgccaucugcuccgccgugcccgucgacugggugcccaccagccggacgaccugguccauccacgcgcaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugacggcccgcgccaccugggccagcaacauccaggucgccaucaaccaggugcgccggcugaucgggaacgagaacuaccucgacuacaugaccuccaugaagcgcuucaagaacgagggcgaccccgagggggugcugugguga

SEQ ID NO: 8589 - RNA, 9879 nt, Artificial Sequence
  derived and/or modified CDS sequence (opt1) from DENV-1__FJ898417__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgacccggucgacugggugcccaccagccgcaccaccugguccauccacgcccaccaccaguggaugacgaccgaggacaugcucagcguguggaaccgggucuggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccagguggccaucaaccagguccgccgccugaucggcaacgagaacuaccuggacuacaugaccagcaugaagcgguucaagaacgaguccgacccggagggggcccucugguga

SEQ ID NO: 8590 - RNA, 9879 nt, Artificial Sequence
  derived and/or modified CDS sequence (opt1) from DENV-1__GQ868612__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgccauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagccucaucgaggugaagaccugcaucuggcccaagucccacacgcuguggagcaacggggugcuggaguccgagaugaucauccccaagaucuacggcgggccgaucagccagcacaacuaccgccccggcuacuucacccagaccgccgggcccuggcaccucggcaagcuggagcuggacuucgaccucugcgagggcaccacggucgugguggacgagcacugcgggaaccggggcccgucccugcgcaccaccaccgucacggggaagaucauccacgaguggugcugccggagcugcacccugccgccccugcgcuuccggggcgaggacgggugcugguacggcauggagauccgccccgugaaggagaaggaggagaaccuggugaaguccauggucagcgccggcagcggggagguggacuccuucagccugggccuccugugcaucuccaucaugaucgaggaggugaugcggagccgcuggucccggaagaugcugaugaccgggacccucgcggucuucuuccugcugaucaugggccagcucacguggaacgaccugauccgccugugcaucauggugggggccaacgccagcgaccgcaugggcaugggcaccaccuaccucgcccugauggccaccuucaagaugcggccgauguucgcgguggggcuccucuuccgccggcugacgucccgcgagguccugcuccugaccaucggccugagccucguggccuccguggagcugcccaacagccuggaggagcucggggacggccuggccaugggcaucaugauccugaagcuccugaccgacuuccagucccaccagcugugggccacccuccugagccugacguucaucaagaccaccuucucccuccacuacgcguggaagaccauggccaugguccugagcaucgugucccuguucccccucugccugagcacgaccucccagaagaccaccuggcugcccguccuccuggggagccugggcugcaagccgcucacgauguuccugaucgccgagaacaagaucugggggcggaaguccuggccccugaacgagggcaucauggccguggggaucgugagcauccuccugagcucccugcucaagaacgacgucccccuggccggcccccugaucgcgggcgggaugcucaucgccugcuacgugaucagcggcuccagcgccgaccugucccuggagaaggccgccgaggugagcugggaggaggaggcggagcacuccggggccagccacaacauccucgucgaggugcaggacgacggcaccaugaagaucaaggacgaggagcgcgacgacacccugaccauccugcucaaggccacccugcuggccguguccggggucuacccgcucagcauccccgccacgcuguucgugugguacuucuggcagaagaagaagcagcgguccggcgugcugugggacacccccagcccgcccgaggucgagcgcgcggugcuggacgacggcaucuaccggaucaugcagcgcgggcuccugggccggucccaggugggggucggcguguuccaggagaacguguuccacaccauguggcacgucacccgcggggccgugcugauguaccagggcaagcggcucgagcccagcugggccuccgugaagaaggaccugaucagcuacggcgggggcuggcgccugcggggguccuggaacacgggcgaggagguccaggugaucgccguggagcccgggaagaaccccaagaacguccagaccgcccccggcaccuucaagacccccgagggcgaggugggggcgaucgcccucgacuucaagcccggcacgagcgggucccccaucgugaaccgcgagggcaagaucgucggccuguacgggaacggcguggugaccaccagcgggaccuacgucagcgccaucgcccaggcgaaggccucccaggagggcccgcugcccgagaucgaggacgagguguuccggaagcgcaaccucacgaucauggaccugcaccccgggagcggcaagacccggcgcuaccugccggccaucgugcgggaggccaucaagcgcaagcuccgcacccugauccuggcccccacccgggucguggcguccgagauggccgaggcccucaagggcaugcccauccgcuaccagacgaccgccgucaagagcgagcacaccgggaaggagaucgucgaccugaugugccacgccaccuucacgaugcggcugcucucccccgugcgcgugccgaacuacaacaugaucaucauggacgaggcgcacuucaccgaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgcgaacugccugcggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccgcgccggugccucaagcccgucauccugaaggacggccccgagcgcgugauccuggccgggcccaugccggugacggucgccuccgcggcccagcggcgcggccggaucggccgcaaccacaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgcggccguggacggcgaguaccggcugcgcggggaggcccggaagaccuucgucgagcugaugcgccggggcgaccuccccguguggcuguccuacaagguggccagcgagggcuuccaguacagcgaccgccgguggugcuucgacggggagcgcaacaaccagguccuggaggagaacauggacguggagaucuggacgaaggagggcgagcggaagaagcuccgcccccgguggcuggacgcccgcaccuacuccgacccccuggcgcuccgggaguucaaggaguucgccgccgggcgccggagcguguccggcgaccugauccuggagaucggcaagcucccgcagcaccugacccagcgcgcccagaacgcgcuggacaaccucgucaugcugcacaacagcgagcagggcgggcgggccuaccgccacgccauggaggagcugcccgacaccaucgagacgcucaugcugcuggcccucaucgccgugcugaccgggggcgugacccuguucuuccucuccgggcggggccugggcaagaccagcaucgggcugcucugcgucauggcguccagcgugcugcuguggauggccuccguggagccccacuggaucgccgccagcaucauccucgaguucuuccugaugguccugcucauccccgagccggaccgccagcggacgccccaggacaaccagcuggccuacguggugaucggccuccucuucaugauccugacggucgcggccaacgagauggggcugcucgagaccaccaagaaggaccugggcaucgggcacguggccguggagaaccaccaccacgccgccaugcuggacgucgaccuccaccccgcguccgccuggacccuguacgccguggccacgaccaucaucaccccgaugaugcgccacaccaucgagaacacgaccgccaacaucagccugaccgcgaucgccaaccaggccgccauccucaugggccuggacaagggcuggcccaucuccaagauggacaucggggugccccugcucgcgcugggcugcuacagccaggucaacccccugacccucacggccgccgugcugaugcugguggcccacuacgccaucaucgggccgggccuccaggcgaaggccacccgcgaggcccagaagcggaccgccgccgggaucaugaagaaccccaccgucgacggcaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgugagcauggcgaacaucuuccggggcuccuaccucgccggcgccgggcuggccuucagccugaugaagucccucggcgggggccgccgggggaccggcgcgcagggcgagacccugggggagaaguggaagcgccagcugaaccagcucuccaagagcgaguucaacaccuacaagcgguccggcaucauggagguggaccgcagcgaggccaaggaggggcugaagcggggcgagacgaccaagcacgccgucucccgcgggaccgccaagcugcggugguucguggagcgcaaccuggugaagcccgagggcaaggucaucgaccucggcugcgggcggggcggguggagcuacuacugcgccggccugaagaaggugaccgaggugaagggguacacgaagggcggccccgggcacgaggagcccaucccgauggcgaccuacggcuggaaccuggucaagcuccacuccgggaaggacguguucuucaucccgcccgagaagugcgacacccugcugugcgacaucggcgagagcucccccaacccgaccaucgaggaggggcgcacgcuccgggugcugaagauggucgagcccuggcugcgcggcaaccaguucugcaucaagauccucaaccccuacaugcccagcgugguggagacccuggagcagaugcagcggaagcacggcgggaugcugguccgcaacccgcucucccggaacagcacccacgagauguacuggguguccugcggcaccgggaacaucgugagcgccgucaacaugaccucccgcaugcugcugaaccgcuucacgauggcccaccggaagcccaccuacgagcgcgacguggaccucggcaccggcacccggcacguggccgucgagcccgagguggccaaccuggacaucaucgggcagcgcaucgagaacaucaagcacgagcacaagagcacguggcacuacgacgaggacaaccccuacaagaccugggcguaccacggcuccuacgaggugaagccgagcggguccgccagcagcauggucaacggcguggucaagcugcucaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcgcgcuggcuguggggcuuccugucccggaacaagaagccccgcaucugcacccgggaggaguucacgcgcaagguccggagcaacgccgccaucggggccguguucguggacgagaaccaguggaacuccgcgaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcagccgcgccaucugguacauguggcucggcgcgcgguuccuggaguucgaggcccugggguucaugaacgaggaccacugguucucccgcgagaacagccucuccggcgucgagggggagggccugcacaagcugggguacauccuccgggacaucagcaagauccccggcggcaacauguacgccgacgacaccgccgggugggacacccgcaucacggaggacgaccugcagaacgaggccaagaucaccgacaucauggagccggagcacgcgcugcucgccaaggccaucuucaagcugaccuaccagaacaagguggugcgcguccagcggcccgccaagaacggcaccgugauggacgugaucucccgccgggaccagcgcgggagcggccaggucggcacguacgggcugaacaccuucaccaacauggaggcccagcucauccggcagauggaguccgagggcaucuucagccccuccgagcuggagacccccaaccuggcggagcgcgcccucgacuggcuggagaaguacgggguggagcggcugaagcgcauggccaucagcggcgacgacugcguggucaagccgaucgacgaccgguucgccacggcccucaccgcgcugaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcucguggggcgggcccgcgucucccagggcgccggguggagccugcgggagaccgccugccugggcaagagcuacgcgcagauguggcagcucauguacuuccaccgccgggaccugcgccuggccgccaacgccaucugcuccgccgugcccguggacuggguccccaccagccggacgaccugguccauccacgcgcaccaccaguggaugaccaccgaggacaugcucagcguguggaaccgcguguggaucgaggagaaccccuggauggaggacaagacgcacaucuccagcugggaggacgucccguaccuggggaagcgcgaggaccaguggugcggcucccugaucggccucaccgcccgggccaccugggccaccaacauccagguggccaucaaccaggugcgccggcugaucgggaacgagaacuaccuggacuacaugaccagcaugaagcgcuucaagaacgaguccgaccccgagggcgcgcucugguga

SEQ ID NO: 8591 - RNA, 9879 nt, Artificial Sequence
  derived and/or modified CDS sequence (opt1) from DENV-1__FJ898419__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggguggacccuguucuuccucagcggccgggggcugggcaagaccuccaucggccugcucugcgucauggcgagcuccgugcugcuguggauggccagcguggagccccacuggaucgccgccuccaucauccucgaguucuuccugaugguccugcucauccccgagcccgaccgccagcggaccccgcaggacaaccagcuggccuacguggugaucgggcuccucuucaugauccugaccgucgcggccaacgagaugggccugcucgagacgaccaagaaggaccuggggaucggccacguggccguggagaaccaccaccacgccgccaugcuggacgucgaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgugccccugcucgcgcuggggugcuacucccaggucaacccccugacccucaccgccgccgugcugaugcugguggcccacuacgccaucaucggccccgggcuccaggcgaaggccacgcgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggagguggaccgcuccgaggccaaggagggccugaagcgcggggagaccacgaagcacgccgucagccgcggcaccgccaagcugcggugguucguggagcgcaaccucgugaagccggaggggaaggucaucgaccugggcugcggccgcggcgggugguccuacuacugcgccgggcugaagaaggugaccgaggugaagggguacaccaagggcgggcccggccacgaggagcccauccccauggcgacguacggguggaaccuggucaagcuccacagcggcaaggacguguucuucaucccgcccgagaagugcgacacccugcugugcgacaucggggaguccagccccaaccccaccaucgaggagggccgcacccuccgggugcugaagauggucgagccguggcugcgcgggaaccaguucugcaucaagauccucaaccccuacaugcccuccgugguggagacgcuggagcagaugcagcggaagcacggcggcaugcugguccgcaacccccucagccggaacuccacccacgagauguacugggugagcugcgggaccggcaacaucguguccgccgucaacaugaccagccgcaugcugcugaaccgguucaccauggcccaccgcaagccgacguacgagcgcgacguggaccucggggccggcacccggcacguggccgucgagcccgagguggcgaaccuggacaucaucggccagcgcaucgagaacaucaagcacgagcacaaguccaccuggcacuacgacgaggacaaccccuacaagaccugggccuaccacgggagcuacgaggugaagcccuccggcagcgccagcuccauggucaacgggguggucaagcugcucacgaagccgugggacgugauccccauggugacccagaucgccaugaccgacaccacgcccuucggccagcagcgggucuucaaggagaagguggacacccgcacccccaaggccaagcgggggaccgcgcagaucauggaggugacggccaaguggcuguggggcuuccugagccgcaacaagaagccgcggaucugcacccgcgaggaguucacccggaagguccgcuccaacgccgccaucggcgcgguguucguggacgagaaccaguggaacagcgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcggggucgagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaagguggugcgcguccagcggccggccaagaacgggaccgugauggacgugaucucccgccgcgaccagcggggcagcgggcaggucggcaccuacggccugaacaccuucacgaacauggaggcccagcucauccgccagauggaguccgaggggaucuucagccccuccgagcuggagacccccaaccuggcgggccgggugcucgacuggcuggagaagcacgggguggagcgccugaagcggauggccaucagcggcgacgacugcgucgugaagcccaucgacgaccgcuucgccaccgcccucaccgcccugaacgacauggggaaggugcggaaggacaucccgcagugggagcccuccaagggcuggaacgacuggcagcagguccccuucugcagccaccacuuccaccagcugaucaugaaggacggccgcgagaucguggugcccugccggaaccaggacgagcucgucgggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgugccggucgacugggugcccaccagccgcaccaccugguccauccacgcccaccaccaguggaugacgaccgaggacaugcucagcguguggaaccgggucuggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccagguggccaucaaccagguccgccgccugaucggcaacgagaacuaccuggacuacaugaccagcaugaagcgguucaagaacgaguccgacccggagggggcccucugguga

SEQ ID NO: 8592 - RNA, 9879 nt, Artificial Sequence
  derived and/or modified CDS sequence (opt1) from DENV-1__FJ898420__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgccauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggccggcucgagcuggacuucgaccugugcgagggcaccacggucgugguggacgagcacugcgggaaccgcggcccgucccuccggaccaccaccgucacggggaagaucauccacgaguggugcugccgcagcugcacccugccgccccugcgguuccgcggcgaggacgggugcugguacggcauggagauccggcccgugaaggagaaggaggagaaccucgugaaguccauggucagcgccggcagcggggagguggacuccuucagccugggccugcucugcaucuccaucaugaucgaggaggugaugcgcagccgguggucccgcaagaugcugaugaccgggacccuggcggucuucuuccuccugaucaugggccagcugacguggaacgaccucauccgccugugcaucauggugggggccaacgccagcgaccggaugggcaugggcaccaccuaccuggcccucauggccaccuucaagaugcgcccgauguucgcgguggggcugcuguuccggcgccucacgucccgggagguccugcugcucaccaucggccugagccugguggccuccguggagcuccccaacagccuggaggagcugggggacggccucgccaugggcaucaugauccugaagcugcucaccgacuuccagucccaccagcugugggccacccugcucagccugacguucaucaagaccaccuucucccugcacuacgcguggaagaccauggccaugguccucagcaucgugucccuguucccccugugccucagcacgaccucccagaagaccaccuggcugcccguccugcucgggagccugggcugcaagccgcugacgauguuccucaucgccgagaacaagaucugggggcgcaaguccuggccccugaacgagggcaucauggccguggggaucgugagcauccugcucagcucccugcugaagaacgacgucccccucgccggcccccugaucgcgggcgggaugcugaucgccugcuacgugaucagcggcuccagcgccgaccucucccuggagaaggccgccgaggugagcugggaggaggaggcggagcacuccggggccagccacaacauccuggucgaggugcaggacgacggcaccaugaagaucaaggacgaggagcgggacgacacccucaccauccugcugaaggccacccuccuggccguguccggggucuacccgcugagcauccccgccacccucuucgugugguacuucuggcagaagaagaagcagcgcuccggcgugcugugggacacccccagcccgcccgaggucgagcgggcggugcuggacgacggcaucuaccgcaucaugcagcgggggcugcucggccgcucccaggugggggucggcguguuccaggagaacguguuccacaccauguggcacgucacccgcggggccgugcugauguaccagggcaagcgccuggagcccagcugggccuccgugaagaaggaccucaucagcuacggcgggggcuggcggcugcgcggguccuggaacacgggcgaggagguccaggugaucgccguggagcccgggaagaaccccaagaacguccagaccgcccccggcaccuucaagacccccgagggcgaggugggggcgaucgcccuggacuucaagcccggcacgagcgggucccccaucgugaaccgggagggcaagaucgucggccucuacgggaacggcguggugaccaccagcgggaccuacgucagcgccaucgcccaggcgaaggccucccaggagggcccgcugcccgagaucgaggacgagguguuccgcaagcggaaccugacgaucauggaccuccaccccgggagcggcaagacccgccgguaccugccggccaucgugcgcgaggccaucaagcgcaagcugcggacccucauccuggcccccacccgcgucguggcguccgagauggccgaggcccugaagggcaugcccauccgguaccagacgaccgccgucaagagcgagcacaccgggaaggagaucgucgaccucaugugccacgccaccuucacgaugcgccugcugucccccgugcgggugccgaacuacaacaugaucaucauggacgaggcgcacuucaccgaccccagcuccaucgccgcccgcggcuacaucagcacccgggucgggaugggcgaggccgccgcgaucuucaugaccgccacgccgcccggguccguggaggccuucccgcagagcaacgccgugauccaggacgaggagcgcgacauccccgagcgguccuggaacagcggcuacgaguggaucaccgacuuccccggcaagaccgucugguucgugcccuccaucaagagcgggaacgacaucgcgaacugccuccgcaagaacggcaagcgggugauccagcugucccgcaagaccuucgacacggaguaccagaagaccaagaacaacgacugggacuacgucgugaccaccgacaucagcgagaugggggccaacuuccgggccgaccgcgugaucgacccgcggcgcugccugaagcccgucauccucaaggacggccccgagcgggugauccuggccgggcccaugccggugacggucgccuccgcggcccagcgccggggccgcaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgcggccguggacggcgaguaccgccuccgcggggaggcccgcaagaccuucgucgagcugaugcggcgcggcgaccugcccguguggcucuccuacaagguggccagcgagggcuuccaguacagcgaccggcgcuggugcuucgacggggagcggaacaaccagguccuggaggagaacauggacguggagaucuggacgaaggagggcgagcgcaagaagcugcggccccgcuggcucgacgcccggaccuacuccgacccccuggcgcugcgcgaguucaaggaguucgccgccgggcggcgcagcguguccggcgaccucauccuggagaucggcaagcugccgcagcaccucacccagcgggcccagaacgcgcuggacaaccuggucaugcuccacaacagcgagcagggcgggcgcgccuaccggcacgccauggaggagcugcccgacaccaucgagacgcugaugcuccuggcccugaucgccgugcucaccgggggcgugacccuguucuuccuguccgggcgcggccucggcaagaccagcaucgggcugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucacggucgcggccaacgagauggggcugcuggagaccaccaagaaggaccucggcaucgggcacguggccguggagaaccaccaccacgccgccaugcuggacgucgaccugcaccccgcguccgccuggacccucuacgccguggccacgaccaucaucaccccgaugaugcgccacaccaucgagaacacgaccgccaacaucagccugaccgcgaucgccaaccaggccgccauccugaugggccucgacaagggcuggcccaucuccaagauggacaucggggugccccugcuggcgcucggcugcuacagccaggucaacccccugacccugacggccgccgugcucaugcugguggcccacuacgccaucaucgggccgggccugcaggcgaaggccacccgggaggcccagaagcgcaccgccgccgggaucaugaagaaccccaccgucgacggcaucguggcgaucgaccucgaccccguggucuacgacgccaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgugagcauggcgaacaucuuccgcggcuccuaccuggccggcgccgggcucgccuucagccugaugaagucccugggcgggggccggcgcgggaccggcgcgcagggcgagacccucggggagaaguggaagcggcagcugaaccagcuguccaagagcgaguucaacaccuacaagcgcuccggcaucauggagguggaccggagcgaggccaaggaggggcucaagcgcggcgagacgaccaagcacgccgucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacacgaagggcggccccgggcacgaggagcccaucccgauggcgaccuacggcuggaaccuggucaagcugcacuccgggaaggacguguucuucaucccgcccgagaagugcgacacccuccugugcgacaucggcgagagcucccccaacccgaccaucgaggaggggcggacgcugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacccacgagauguacuggguguccugcggcaccgggaacaucgugagcgccgucaacaugaccucccgcaugcuccugaaccgguucacgauggcccaccgcaagcccaccuacgagcgggacguggaccugggcaccggcacccgccacguggccgucgagcccgagguggccaaccucgacaucaucgggcagcggaucgagaacaucaagcacgagcacaagagcacguggcacuacgacgaggacaaccccuacaagaccugggcguaccacggcuccuacgaggugaagccgagcggguccgccagcagcauggucaacggcguggucaagcugcugaccaagcccugggacgugauccccauggugacccagaucgccaugacggacaccacccccuucgggcagcagcgcgucuucaaggagaagguggacacccggacgccgaaggccaagcgcggcaccgcccagaucauggaggugaccgcgcgguggcucuggggcuuccugucccgcaacaagaagccccggaucugcacccgcgaggaguucacgcggaagguccgcagcaacgccgccaucggggccguguucguggacgagaaccaguggaacuccgcgaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacaccgccgggugggacacccgcaucacggaggacgaccuccagaacgaggccaagaucaccgacaucauggagccggagcacgcgcugcuggccaaggccaucuucaagcucaccuaccagaacaagguggugcggguccagcgccccgccaagaacggcaccgugauggacgugaucucccggcgcgaccagcgggggagcggccaggucggcacguacgggcugaacaccuucaccaacauggaggcccagcugauccgccagauggaguccgagggcaucuucagccccuccgagcucgagacccccaaccuggcggagcgggcccuggacuggcucgagaaguacgggguggagcgccugaagcggauggccaucagcggcgacgacugcguggucaagccgaucgacgaccgcuucgccacggcccugaccgcgcucaacgacauggggaaggugcggaaggacaucccccagugggagcccuccaagggcuggaacgacuggcagcagguccccuucugcagccaccacuuccaccagcugaucaugaaggacggccgcgagaucgucgugccgugccggaaccaggacgagcugguggggcgcgcccgggucucccagggcgccggguggagccuccgcgagaccgccugccugggcaagagcuacgcgcagauguggcagcugauguacuuccacaagcgggaccuccgccuggccgccaacgccaucugcuccgccgugcccguggacuggguccccaccagccggacgaccugguccauccacgcgcaccaccaguggaugaccaccgaggacaugcugagcguguggaaccgcguguggaucgaggagaaccccuggauggaggacaagacgcacaucuccagcugggaggacgucccguaccucgggaagcgcgaggaccaguggugcggcucccugaucggccugaccgcccgggccaccugggccaccaacauccagguggccaucaaccaggugcgccggcucaucgggaacgagaacuaccuggacuacaugaccagcaugaagcgcuucaagaacgaguccgaccccgagggcgcgcugugguga

SEQ ID NO: 8593 - RNA, 9879 nt, Artificial Sequence
  derived and/or modified CDS sequence (opt1) from DENV-1__FJ898421__SS-prME
agcgugaccaugcugcucaugcugaugcccaccgcccuggccuuccaccucaccacccgcggcggggagccccacaugaucguguccaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucuccaucagcaucaugaucgaggaggucaugcggucccgcuggagccggaagaugcugaugaccgggacccuggccguguucuuccuccugaucaugggccagcugacguggaacgaccucauccgccugugcaucauggugggggcgaacgccuccgaccgcaugggcaugggcaccaccuaccuggcccucauggccaccuucaagaugcggccgauguucgccgucgggcugcuguuccgccggcucacgagccgcgaggugcugcugcucaccaucggccugucccugguggcgagcgucgagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgauggugcucuccaucgucagccuguucccccugugccucuccacgaccagccagaagaccaccuggcugcccgugcugcucgggucccugggcugcaagccgcugacgauguuccucaucgccgagaacaagaucugggggcggaaguccuggccccugaacgagggcaucauggccguggggaucgucagcauccugcucuccagccugcugaagaacgacgugccccucgccggcccccugaucgccggcgggaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgcgacgacacccucaccauccugcugaaggccacccuccuggccgucagcgggguguacccgcuguccauccccgccacccucuucgugugguacuucuggcagaagaagaagcagcggagcggcguccugugggacacccccagcccgcccgagguggagcgcgccgugcuggacgacggcaucuaccggaucaugcagcgcgggcugcucggccggagccaggucggggugggcguguuccaggagaacgucuuccacaccauguggcacgugacccgcggggcggugcugauguaccagggcaagcggcuggagcccuccugggccagcgucaagaaggaccucaucuccuacggcgggggcuggcgccugcgggggagcuggaacacgggcgaggagguccaggugaucgccgucgagcccgggaagaaccccaagaacgugcagaccgcccccggcaccuucaagacccccgagggcgaggugggggccaucgcgcuggacuucaagcccggcacguccgggagccccaucgucaaccgcgagggcaagaucgugggccucuacgggaacggcguggucaccaccagcgggaccuacguguccgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaagggcaugcccauccgcuaccagacgaccgccgucaaguccgagcacaccgggaaggagaucguggaccucaugugccacgccaccuucacgaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugaccgcgacgccgcccgggagcguggaggccuucccgcaguccaacgccgucauccaggacgaggagcgggacauccccgagcgcagcuggaacuccggcuacgaguggaucaccgacuuccccggcaagaccgugugguucgugcccagcaucaaguccgggaacgacaucgccaacugccuccggaagaacggcaagcgcgucauccagcugagccggaagaccuucgacacggaguaccagaagaccaagaacaacgacugggacuacguggugaccaccgacaucuccgagaugggggcgaacuuccgcgccgaccgggucaucgacccgcgccggugccugaagcccgugauccucaaggacggccccgagcgcgugauccuggccgggcccaugccggucacgguggccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucagcuacaaggucgccagcgagggcuuccaguacuccgaccgccgguggugcuucgacggggagcgcaacaaccaggugcuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgucagcggcgaccucauccuggagaucggcaagcugccgcagcaccucacccagcgcgcccagaacgcccuggacaaccuggugaugcuccacaacuccgagcagggcgggcgggcguaccgccacgccauggaggagcugcccgacaccaucgagacgcugaugcuccuggcccugaucgccgugcucaccgggggcgucacccuguucuuccugagcgggcggggccucggcaagaccuccaucgggcugcugugcgugauggccagcuccgugcuccuguggauggcgagcgucgagccccacuggaucgccgccuccaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggucccccugcuggcccucggcugcuacucccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgagccagauccugcucaugcgcaccaccugggcccugugcgaguccaucacccuggccacggggccccucaccacccugugggagggcagcccggggaaguucuggaacaccacgaucgccguguccauggccaacaucuuccggggcagcuaccuggcgggcgccgggcucgccuucagccugaugaagucccugggcgggggccgccgggggaccggcgcccagggcgagacccucggggagaaguggaagcgccagcugaaccagcugagcaaguccgaguucaacaccuacaagcggagcggcaucauggaggucgaccgcuccgaggcgaaggaggggcucaagcggggcgagacgaccaagcacgccgugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacacgaagggcggccccgggcacgaggagcccaucccgauggccaccuacggcuggaaccuggugaagcugcacagcgggaaggacguguucuucaucccgcccgagaagugcgacacccuccugugcgacaucggcgaguccagccccaacccgaccaucgaggaggggcgcacgcugcggguccucaagaugguggagcccuggcugcgcggcaaccaguucugcaucaagauccugaaccccuacaugcccuccguggucgagacccucgagcagaugcagcggaagcacggcgggaugcuggugcgcaacccgcugagccggaacuccacccacgagauguacugggugagcugcggcaccgggaacaucgucuccgcggugaacaugaccagccgcaugcuccugaaccgcuucacgauggcccaccggaagcccaccuacgagcgcgacguggaccugggcaccggcacccggcacgucgccguggagcccgagguggccaaccucgacaucaucgggcagcgcaucgagaacaucaagcacgagcacaaguccacguggcacuacgacgaggacaaccccuacaagaccugggccuaccacggcagcuacgaggucaagccguccgggagcgcgagcuccauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcucuggggcuuccugagccggaacaagaagccccgcaucugcacccgggaggaguucacgcgcaaggugcgguccaacgcggccaucggggccguguucgucgacgagaaccaguggaacagcgccaaggaggcgguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacucccugagcggcguggagggggagggccuccacaagcugggguacauccugcgggacaucuccaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacggcaccgugauggacgucaucagccgccgggaccagcgcggguccggccaggugggcacguacgggcugaacaccuucaccaacauggaggcccagcugauccggcagauggagagcgagggcaucuucucccccagcgagcucgagacccccaaccuggccgagcgcgcgcuggacuggcucgagaaguacgggguggagcggcugaagcgcauggccaucuccggcgacgacugcgucgugaagccgaucgacgaccgguucgccacggcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcgcgcgugagccagggcgccggguggagccuccgggagaccgccugccugggcaaguccuacgcccagauguggcagcugauguacuuccaccgccgggaccuccgccuggcggccaacgccaucugcagcgccgugcccgucgacugggugcccaccucccggacgaccuggagcauccacgcccaccaccaguggaugaccaccgaggacaugcuguccguguggaaccgcgucuggaucgaggagaaccccuggauggaggacaagacgcacaucagcuccugggaggacgugccguaccucgggaagcgcgaggaccaguggugcggcagccugaucggccugaccgcgcgggccaccugggccaccaacauccagguggccaucaaccagguccgccggcucaucgggaacgagaacuaccuggacuacaugaccuccaugaagcgcuucaagaacgagagcggccccgagggggcccugugguga

SEQ ID NO: 8594 - RNA, 9879 nt, Artificial Sequence
  derived and/or modified CDS sequence (opt1) from DENV-1__FJ898423__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacgucgacugcuggugcaacaccacggacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucauccaguacgagaaccugaaguacagcgugaucgugaccguccacaccggcgaccagcaccagguggggaacgaguccacggagcacggcaccaucgccaccaucacgccccaggcgcccaccagcgagauccagcucacggacuacggggcccugacccuggacugcagcccccggaccggccucgacuucaacgagaugguccugcugaccaugaaggagaaguccuggcucgugcacaagcagugguuccuggaccugccccuccccuggacgagcggggccuccaccagccaggagaccuggaaccgccaggaccugcuggugaccuucaagacggcccacgccaagaagcaggaggucguggugcucggcucccaggagggcgcgaugcacaccgcccugaccggggccaccgagauccagacgaccggcaccaccacgaucuucgccgggcaccugaagugccggcucaagauggacaagcugacccugaagggcaugagcuacgucaugugcaccggguccuucaagcucgagaaggagguggccgagacccagcacggcacggugcugguccagaucaaguacgagggcaccgacgcgcccugcaagauccccuucagcacccaggacgagaagggggugacccagaacggccgccugaucacggccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccgccggauggccauccugggcgacaccgcgugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucaucacccuguaccugggcgucauggugcaggccgacuccgggugcgugaucaacuggaagggccgcgagcucaagugcgggagcggcaucuucgucaccaacgaggugcacacguggaccgagcaguacaaguuccaggccgacagcccgaagcggcuguccgcggccaucggcaaggccugggaggagggggugugcggcauccgcagcgccacccggcuggagaacaucauguggcgccagaucuccaacgagcucaaccacauccugcuggagaacgacaugaaguucaccgucguggugggggacgucgugggcauccucgcccaggggaagaagauggugcggccccagcccauggagcacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuucuuccugcucaucauggggcagcugaccuggaacgaccugauccggagcugcaucauggugggcgccaacgccuccgaccgcauggggaugggcacgaccuaccucgcgcugauggccaccuucaagaugcgcccgauguucgccgugggccuccuguuccggcgccugaccagccgggagguccugcuccugacgaucgggcugucccucguggccagcgucgagcugcccaacucccuggaggagcucggcgacgggcuggccaugggcaucaugauccugaagcuccugaccgacuuccagagcuaccagcugugggcgacccuccugucccugaccuucaucaagacgaccuucagccuccacuacgccuggaagaccauggccauggugcuguccaucgugagccugcucccccugugccuguccaccacgagccagaagaccaccuggcuccccguccugcugggcucccucgggugcaagccgcugaccauguuccugaucgccgagaacaagaucuggggccgcaagagcuggccccucaacgaggggaucauggcggugggcaucgugagcauccugcuguccagccuccugaagaacgacgucccccuggccgggccccucaucgccggcggcaugcugaucgccugcuacgugaucuccgggagcuccgccgaccugagccucgagaaggcggccgagguguccugggaggaggaggccgagcacagcggcgccucccacaacauccuggucgaggugcaggacgacgggacgaugaagaucaaggacgaggagcgggacgacacccugaccauccuccugaaggccacccugcucgcggugagcggcgucuacccgcuguccauccccgccacccuguucgugugguacuucuggcagaagaagaagcagcgcagcggggugcucugggacacgcccagcccgcccgaggucgagcgggccgugcuggacgacggcaucuaccgcaucaugcagcggggccugcuggggcgcagccaggugggcgucgggguguuccaggagaacguguuccacaccauguggcacgucacccggggcgccgugcucauguaccaggggaagcgccuggagcccuccugggccagcgugaagaaggaccugaucuccuacggcggcggguggcggcuccagggcagcuggaacaccggggaggagguccaggugaucgcgguggagcccggcaagaaccccaagaacguccagacggcccccgggaccuucaagacccccgagggcgaggugggcgccaucgcccuggacuucaagcccgggaccuccggcagccccaucgugaaccgcgaggggaagaucgucggccuguacggcaacgggguggugacgaccagcggcaccuacgucuccgccaucgcgcaggccaaggccagccaggaggggccgcuccccgagaucgaggacgagguguuccggaagcgcaaccugaccaucauggaccugcaccccggcuccgggaagacgcggcgcuaccucccggccaucgugcgggaggcgaucaagcgcaagcugcggacccugauccucgcccccacccgcgucguggccagcgagauggccgaggcccugaagggcaugcccauccgcuaccagaccacggcggugaaguccgagcacaccggccgggagaucgucgaccugaugugccacgccaccuucaccaugcgccuccugagccccgugcgggugccgaacuacaacaugaucaucauggacgaggcccacuucacggaccccuccagcaucgccgcccgcggguacaucuccacccgggucggcaugggggaggcggccgccaucuucaugaccgccacgccgcccggcagcguggaggccuucccgcaguccaacgcggugauccaggacgaggagcgcgacauccccgagcggagcuggaacuccggguacgaguggaucacggacuuccccggcaagaccgucugguucgugcccagcaucaaguccggcaacgacaucgccaacugccugcgcaagaacgggaagcgggugauccagcucagccgcaagaccuucgacaccgaguaccagaagacgaagaacaacgacugggacuacgucgugaccaccgacaucuccgagaugggcgccaacuuccgggccgaccgcgugaucgacccgcggcgcugccugaagcccgucauccugaaggacgggcccgagcgggugauccucgcgggccccaugccggucaccguggccagcgccgcccagcgccgggggcgcaucggccggaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccgccugcggggcgaggcccgcaagaccuucguggagcucaugcggcgcggggaccugcccgucuggcugagcuacaagguggcgagcgagggcuuccaguacuccgaccggcgcuggugcuucgacggcgagcggaacaaccaggugcucgaggagaacauggacgucgagaucuggaccaaggagggggagcgcaagaagcugcggccccgcuggcuggacgcccggacguacagcgacccccucgcccugcgcgaguucaaggaguucgccgccggccggcgcuccgugagcggggaccugauccucgagaucggcaagcugccgcagcaccugacccagcgggcgcagaacgcccucgacaaccuggugaugcugcacaacuccgagcagggcgggcgcgccuaccggcacgccauggaggagcuccccgacaccaucgagacccugaugcugcucgcgcugaucgccguccugacgggcggggugacccucuucuuccugagcggccgcgggcugggcaagaccuccaucggccuccugugcgugauggccagcuccgcccugcucuggauggccagcgucgagccccacuggaucgcggccuccaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagacgaccaagaaggaccuggggaucggccacguggcggucgagaaccaccaccacgccaccaugcucgacguggaccugcaccccgccagcgccuggacccuguacgccguggcgacgaccaucaucaccccgaugaugcggcacaccaucgagaacacgaccgccaacaucucccucaccgccaucgccaaccaggccgcgauccugauggggcuggacaagggcuggcccaucagcaagauggacaucggcgucccccuccuggcccuggggugcuacucccaggugaacccccucacccugacggccgccgugcugaugcucgucgcgcacuacgccaucaucggcccggggcugcaggccaaggccacccgcgaggcccagaagcgcaccgcggccggcaucaugaagaaccccaccguggacgggaucguggccaucgaccuggaccccgucguguacgacgccaaguucgagaagcagcucggccagaucaugcugcugauccucugcacgagccagauccugcugaugcggaccaccugggcccucugcgaguccaucacccuggcgacgggcccccugaccacccucugggaggggagcccgggcaaguucuggaacaccacgaucgccguguccauggccaacaucuuccgcgggagcuaccuggccggcgccggccuggcguucagccucaugaagucccucgggggcgggcggcgcgggaccggggcccagggcgagacccugggcgagaaguggaagcggcagcucaaccagcugagcaaguccgaguucaacaccuacaagcgcagcgggaucauggaggucgaccgguccgaggccaaggagggccugcgccgcggggagacgaccaagcacgccgugagccgcggcaccgcgaagcuccggugguucguggagcgcaaccuggucaagcccgaggggaaggugaucgaccugggcugcggccgcggcgggugguccuacuacugcgccgggcugaagaaggugaccgaggucaagggguacacgaagggcggccccggccacgaggagcccaucccgauggccaccuacggguggaaccucgugaagcugcacagcggcaaggacguguucuucaucccgcccgagaagugcgacacccugcucugcgacaucggggaguccagccccaacccgaccaucgaggagggccgcacgcugcggguccugaagaugguggagcccuggcuccgcgggaaccaguucugcaucaagauccugaaccccuacaugcccuccguggucgagacccuggagcacaugcagcggaagcacggcggcaugcucgugcgcaacccgcugagccggaacuccacccacgagauguacugggugagcugcgggaccggcaacaucgucuccgccgugaacaugaccagccgcaugcugcucaaccgcuucacgauggcccaccggaagcccaccuacgagcgcgacguggaccugggggcgggcacccggcacgucgccguggagcccgagguggccaaccuggacaucaucggccagcgcaucgagaacaucaagcacgagcacaaguccaccuggcacuacgacgaggacaaccccuacaagacgugggccuaccacgggagcuacgaggucaagccguccggcagcgccagcuccauggugaacggggucgugaagcuccugaccaagcccugggacgugauccccauggucacccagaucgcgaugaccgacacgacccccuucggccagcagcggguguucaaggagaagguggacacccgcaccccgaaggccaagcgggggacggcccagaucauggaggucaccgcccgcuggcuguggggcuuccucagccggaacaagaagccccgcaucugcacccgggaggaguucacccgcaaggugcgguccaacgccgcgaucggcgccguguucgucgacgagaaccaguggaacagcgccaaggaggccguggaggacgagcgcuucugggaccuggugcaccgggagcgcgagcugcacaagcaggggaagugcgcgacgugcgucuacaacaugaugggcaagcgggagaagaagcucggggaguucggcaaggccaaggggucccgcgccaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgcggacgacaccgccggcugggacacccgcaucaccgaggacgaccugcagaacgaggccaagaucacggacaucauggagccggagcacgcccuccuggccaccagcaucuucaagcugaccuaccagaacaaggugguccgcgugcagcggcccgcgaagaacgggaccgugauggacgucaucucccgccgggaccagcgcggcagcggccaggugggcacguacggccucaacaccuucaccaacauggaggcccagcugauccggcagauggaguccgaggggaucuucagccccuccgagcuggagacccccaaccucgccgagcgcgugcuggacuggcuggagaaguacggcgucgagcggcucaagcgcauggccaucagcggggacgacugcguggugaagccgaucgacgaccgguucgccacggcgcugaccgcccugaacgacaugggcaagguccgcaaggacaucccccagugggagcccuccaagggguggaacgacuggcagcagguccccuucugcagccaccacuuccaccagcucaucaugaaggacggccgggagaucguggucccgugccgcaaccaggacgagcuggugggccgggcccgcgugagccagggggccggcuggucccugcgggagaccgccugccucgggaaguccuacgcgcagauguggcagcugauguacuuccaccgccgggaccugcgccucgccgccaacgccaucugcuccgcgguccccguggacugggugcccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugccguaccuggggaagcgcgaggaccaguggugcggcucccucaucggccugaccgcccgggccaccugggccaccaacauccaggucgcgaucaaccaggugcgccggcugaucgggaacgagaacuaccucgacuacaugaccagcaugaagcgcuucaagaacgaguccgaccccgagggcgcccugugguga

SEQ ID NO: 8595 - RNA, 9879 nt, Artificial Sequence
  derived and/or modified CDS sequence (opt1) from DENV-1__FJ898424__SS-prME
agcgugaccaugcugcucaugcugaugcccaccgcccuggccuuccaccucaccacccggggcggggagccccacaugaucgugagcaagcaggagcggggcaagagccugcuguucaagaccagcaccggggugaacaugugcacccucaucgccauggaccugggcgagcugugcgaggacaccaugaccuacaagugcccccggaucaccgagguggagcccgacgacguggacugcuggugcaacacgaccgacaccugggugaccuacgggacgugcagccagaccggcgagcaccggcgcgacaagcggagcguggcccucgcgccccacgucggccuggggcuggagacccgggccgagaccuggaugagcuccgagggcgccuggaagcagauccagaagguggagacgugggcccuccggcaccccggguucaccgugaucgcccuguuccuggcccacgccaucggcaccagcaucacccagaaggggaucaucuucauccuccugaugcuggucacgcccuccauggcgaugcgcugcgugggcaucggcagccgggacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcgcaagcucugcaucgaggccaagaucuccaacaccacgaccgacagccggugcccgacccagggcgaggcgacccuggucgaggagcaggacgccaacuucgugugccgccggacguucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccagcgagauccagcucaccgacuacggggcgcugacccuggacugcagcccccggacgggccucgacuucaacgagauggugcugcugaccaugaaggagaaguccuggcucgugcacaagcagugguuccuggaccugccccuccccuggaccagcggggccuccaccagccaggagacguggaaccgccaggaccugcuggucaccuucaagaccgcccacgccaagaagcaggagguggugguccucggcucccaggagggcgccaugcacaccgcgcugacgggggccaccgagauccagaccagcggcaccacgaccaucuucgccgggcaccugaagugccggcucaagauggacaagcugacccugaagggcauguccuacgugaugugcaccgggagcuucaagcucgagaaggagguggccgagacgcagcacggcaccguccuggugcagaucaaguacgagggcaccgacgcccccugcaagauccccuucuccacccaggacgagaagggggugacgcagaacggccgccugaucaccgcgaacccgaucgucaccgacaaggagaagcccgugaacaucgaggccgagccgcccuucggggagagcuacaucgugaucggcgccggcgagaaggcccugaagcucuccugguucaagaaggggagcuccaucggcaagauguucgaggcgaccgcccgcggggcccgccggauggccauccugggcgacacggccugggacuucgggagcaucggcggcgucuucaccuccguggggaagcuggugcaccagaucuucggcaccgcguacgggguccucuucagcggcguguccuggaccaugaagaucgggaucggcgugcugcugacguggcucggccugaacagccgcuccaccagccuguccaugaccugcaucgccgucgggcucgugacccuguaccugggcgugaugguccaggccgacagcgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcuccgccacccggcuggagaacaucauguggcgccagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggccaagaucaucggcgcggacgugcagaacacgaccuucaucaucgacgggcccaacaccccggagugccccgacgaccagcgcgccuggaacaucugggagguggaggacuacggcuucgggaucuucaccacgaacaucuggcugaagcugcgggacuccuacacccaggucugcgaccaccgccucaugagcgccgccaucaaggacuccaaggcggugcacgccgacaugggcuacuggaucgagagcgagaagaacgagaccuggaagcuggcccgggccuccuucaucgaggugaagaccugcaucuggcccaagagccacacgcugugguccaacggcguccucgagagcgagaugaucauccccaagaucuacgggggcccgaucucccagcacaacuaccgccccggguacuucacccagaccgccggccccuggcaccuggggaagcuggagcucgacuucgaccugugcgagggcaccacggugguggucgacgagcacugcggcaaccgggggccgagccugcgcaccaccaccgugacgggcaagaucauccacgaguggugcugccgguccugcacccugccgccccuccgcuucaagggggaggacggcugcugguacgggauggagauccggcccgugaaggagaaggaggagaaccuggucaagagcauggugagcgcgggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugacguggaacgaccugauccgguccugcaucauggugggcgccaacgccagcgaccgcauggggaugggcaccaccuaccucgcccugauggcgaccuucaagaugcgcccgauguucgccgucggccugcuguuccggcgccugacgucccgggaggugcugcuccugaccaucgggcugagccucgucgccuccguggagcugcccaacagccuggaggagcucggcgacgggcuggccaugggcaucaugauccugaagcuccugaccgacuuccaguccuaccagcugugggccacccuccugagccugacguucaucaagaccaccuucucccuccacuacgcguggaagaccauggccauggugcugagcaucgucucccugcucccccugugccugagcacgaccucccagaagaccaccuggcuccccgugcugcugggcagccucgggugcaagccgcugacgauguuccugaucgccgagaacaagaucuggggccgcaagagcuggccccucaacgaggggaucauggccgugggcaucgucuccauccugcugagcucccuccugaagaacgacgugccccuggcggggccccucaucgccggcggcaugcugaucgccugcuacgugaucagcggguccagcgccgaccugucccucgagaaggccgcggaggucagcugggaggaggaggccgagcacuccggcgccagccacaacauccugguggaggugcaggacgacgggaccaugaagaucaaggacgaggagcgggacgacacccugaccauccuccugaaggccacccugcucgccgucuccggcguguacccgcugagcauccccgcgacgcuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgccgugcucauguaccaggggaagcgccuggagcccagcugggccuccgucaagaaggaccugaucagcuacggcggcggguggcggcuccagggcuccuggaacacgggggaggagguccaggugaucgccgucgagcccggcaagaaccccaagaacgugcagaccgcgcccgggaccuucaagacccccgagggcgaggugggcgccaucgcccuggacuucaagcccgggacgagcggcagccccaucgucaaccgcgaggggaagaucgugggccuguacggcaacgggguggucaccaccuccggcaccuacgugagcgccaucgcccaggcgaaggccucccaggaggggccgcuccccgagaucgaggacgagguguuccggaagcgcaaccugacgaucauggaccugcaccccggcagcgggaagacccggcgcuaccucccggccaucguccgggaggccaucaagcgcaagcugcggacccugauccucgcgcccacccgcgugguggccuccgagauggccgaggcccugaagggcaugcccauccgcuaccagacgaccgccgucaagagcgagcacaccggccgggagaucguggaccugaugugccacgcgaccuucacgaugcgccuccugucccccgugcgggucccgaacuacaacaugaucaucauggacgaggcccacuucaccgaccccagcuccaucgccgcccgcggguacaucagcacccgggugggcaugggggaggccgcggccaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccugcgcaagaacgggaagcgggucauccagcucucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccugaaggacgggcccgagcgggucauccucgccggccccaugccggugacgguggcguccgccgcccagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcgcuguucgagccggagcgcgagaaguccgccgccaucgacggggaguaccgccugcggggcgaggcccgcaagaccuucgucgagcucaugcggcgcggggaccugcccguguggcugagcuacaagguggccuccgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcgcggaccuacuccgacccccucgcccugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacgcugaugcugcucgcccugaucgcggugcugaccggcggggugacccucuucuuccuguccggccgcgggcugggcaagaccagcaucggccuccugugcgucauggccuccagcgcccugcucuggauggccuccguggagccccacuggaucgccgcgagcaucauccuggaguucuuccugauggugcuccugauccccgagccggaccggcagcgcacgccccaggacaaccagcuggccuacgucgugaucgggcuccuguucaugauccugacgguggccgccaacgagaugggccuccuggagaccaccaagaaggaccuggggaucggccacgucgccguggagaaccaccaccacgcgaccaugcucgacguggaccugcaccccgccuccgccuggacgcuguacgccgucgccaccaccaucaucaccccgaugaugcggcacacgaucgagaacaccaccgcgaacaucagccucaccgccaucgccaaccaggccgccauccugauggggcuggacaagggcuggcccaucuccaagauggacaucggcgugccccuccuggcgcuggggugcuacagccaggugaacccccucacgcugaccgccgccguccugaugcucguggcccacuacgcgaucaucggcccggggcugcaggccaaggccacccgcgaggcccagaagcgcaccgccgcgggcaucaugaagaaccccacgguggacgggaucgucgccaucgaccuggaccccgugguguacgacgccaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgcggucagcauggccaacaucuuccgcgggagcuaccuggccggcgccggccuggccuucucccucaugaagucccucgggggcgggcggcgcgggaccggggcgcagggcgagacccugggcgagaaguggaagcggcagcucaaccagcuguccaagagcgaguucaacacguacaagcgcuccgggaucauggagguggaccggagcgaggccaaggagggccugcgccgcggggagaccaccaagcacgccgugucccgcggcaccgccaagcuccggugguucgucgagcgcaaccuggugaagcccgaggggaaggugaucgaccugggcugcggccgcggcggguggagcuacuacugcgcggggcugaagaaggucacggaggugaagggguacaccaagggcgggcccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugacgucccgcaugcugcucaaccgcuucaccauggcccaccggaagcccaccuacgagcgcgacgucgaccugggggccggcacccggcacguggcgguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcagcgccuccagcauggucaacgggguggugaagcuccugaccaagcccugggacgucauccccauggugacccagaucgccaugacggacaccacccccuucggccagcagcggguguucaaggagaaggucgacacccgcacgccgaaggcgaagcgggggaccgcccagaucauggaggugaccgcccgcuggcuguggggcuuccucucccggaacaagaagccccgcaucugcacccgggaggaguucacgcgcaaggugcggagcaacgccgccaucggcgcggucuucguggacgagaaccaguggaacuccgccaaggaggccguggaggacgagcgcuucugggaccugguccaccgggagcgcgagcugcacaagcaggggaagugcgcgaccugcguguacaacaugaugggcaagcgggagaagaagcucggggaguucggcaaggcgaaggggagccgcgccaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgcgggcugggacacccgcaucacggaggacgaccugcagaacgaggccaagaucaccgacaucauggagccggagcacgcccuccuggccaccuccaucuucaagcugaccuaccagaacaaggucgugcgcgugcagcggcccgcccgcaacgggacggucauggacgugaucagccggcgcgaccagcggggcuccggccaggugggcaccuacggccucaacaccuucaccaacauggaggcgcagcugauccgccagauggagagcgaggggaucuucucccccagcgagcuggagacgcccaaccucgccgagcggguccuggacuggcuggagaagcacggcguggagcgccucaagcggauggccaucuccggggacgacugcguggucaagccgaucgacgaccgcuucgccaccgcccugagcgcgcugaacgacaugggcaaggugcggaaggacaucccccagugggagcccagcaagggguggaacgacuggcagcagguccccuucugcucccaccacuuccaccagcucaucaugaaggacggccgcgagaucgucgugccgugccggaaccaggacgagcuggugggccgcgcccgggucagccagggggccggcuggucccugcgcgagaccgccugccucggcaagagcuacgcccagauguggcagcugauguacuuccaccggcgcgaccugcggcucgcggccaacgccaucugcuccgccgugcccguggacuggguccccaccagccgcacgaccugguccauccacgcgcaccaccaguggaugaccaccgaggacaugcugagcguguggaaccgcguguggaucgaggagaaccccuggauggaggacaagacgcacaucuccagcuggggcgacgucccguaccuggggaagcgggaggaccaguggugcggcucccucaucggccugaccgcccgcgccaccugggccaccaacauccagguggccaucaaccaggugcggcgccugaucgggaacgagaacuaccucgacuacaugaccagcaugaagcgguucaagaacgaguccgaccccgagggcgcgcugugguga

SEQ ID NO: 8596 - RNA, 9879 nt, Artificial Sequence
  derived and/or modified CDS sequence (opt1) from DENV-1__FJ898425__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgucgggcuccuguuccggcgccugacgucccgggaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccauggugcucagcaucgucucccugaucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcggacccucauccuggcccccacccgcguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccaccaugcuggacguggaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgggaggcccagaagcgcaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacaucuacaagcgguccgggaucauggaggucgaccgcagcgaggccaaggagggccucaagcgcggggagacgacccgccacgccgugucccggggcaccgcgaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucacgccgcccgagaagugcgacacccuccugugcgacaucggggagagcucccccaacccgacgaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgccgugaacaugacgucccggaugcuccugaaccgcuucaccauggcccaccgcaagcccaccuacgagaaggacguggaccugggggcgggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcugcugaccaagcccugggacgugauccccauggucacccagaucgcgaugacggacaccacccccuucggccagcagcggguguucaaggagaagguggacacccgcacgccgaaggccaagcgggggaccguccagaucauggaggugaccgcccgcuggcucuggggcuuccugucccggaacaagaagccccgcaucugcacccgggaggaguucacgcgcaaggugcggagcaacgccgccaucggcgcggucuucguggacgagaaccaguggaacuccgccaaggaggccguggaggacgagcgcuucugggaccugguccagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgcgggcugggacacccggaucacggaggacgaccuccagaacgaggccaagaucaccgacaucauggagccggagcacgcccugcuggccaccuccaucuucaagcucaccuaccagaacaaggucgugcgcgugcagcggcccgccaagaacgggacggucauggacgugaucagccgccgcgaccagcggggcuccggccaggugggcaccuacggccugaacaccuucaccaacauggaggcgcagcugauccgccagauggagagcgaggggaucuuccuccccuccgagcuggagacgcccaaccuggccgagcggguccucgacuggcuggagaaguacggcguggagcgccugaagcggauggccaucagcggggacgacugcguggucaagccgaucgacgaccgcuucgccaccgcccucaccgcgcugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcccgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccugguccauccacgcgcaccaccaguggaugaccacggaggacaugcucagcguguggaaccggguguggaucgaggagaaccccuggauggaggacaagacccacgucuccagcuggggcgacgugccguaccuggggaagcgcgaggaccaguggugcggcucccugaucggccucaccgcccgggccaccugggccagcaacauccagguggccaucaaccagguccgccgccugaucgggaacgagaacuaccuggacuacaugaccuccaugaagcgguucaagaacgagggcgaccccgagggggcgcucugguga

SEQ ID NO: 8597 - RNA, 9879 nt, Artificial Sequence
  derived and/or modified CDS sequence (opt1) from DENV-1__FJ898426__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucgcgaaccccgccgugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgcgaaguucaagugcgugacgaagcucgagggcaagaucguccaguacgagaaccugaaguacagcgugaucgugaccguccacaccggcgaccagcaccagguggggaacgaguccaccgagcacggcacgaccgccaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggaaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccgccugaagauggacaagcucacgcugaagggcauguccuacgucaugugcaccgggagcuucaagcuggagaaggagguggccgagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggcggagccgcccuucggggagagcuacaucgugaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcguguucaccuccgucgggaagcuggugcaccagaucuucggcacggccuacggggugcuguucagcggcgucuccuggaccaugaagaucgggaucggcgugcuccugaccuggcugggccucaacagccgcuccaccagccuguccaugacgugcaucgccguggggcuggucacccucuaccugggcgugauggugcaggcggacagcgggugcgucaucaacuggaagggccgggagcugaagugcgggagcggcaucuucgugaccaacgaggugcacaccuggacggagcaguacaaguuccaggccgacuccccgaagcgccucagcgccgccaucggcaaggccugggaggagggggucugcggcauccgguccgcgacccgccuggagaacaucauguggaagcagaucagcaacgagcugaaccacauccuccuggagaacgacaugaaguucaccgugguggucggggacguggccggcauccuggcccaggggaagaagaugauccggccccagcccauggaguacaaguacuccuggaaguccuggggcaaggccaagaucaucggcgcggacgugcagaacaccaccuucaucaucgacgggcccaacacgccggagugccccgacgaccagcgcgccuggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgcggacaugggcuacuggaucgagagcgagaagaacgagacguggaagcucgcccgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacccagacggccggccccuggcaccucgggaagcuggagcuggacuucgaccucugcgagggcaccaccguggucguggacgagcacugcggcaaccgggggccgagccugcgcaccacgaccgugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugacgggcacccucgcgguguucuuccugcugaucauggggcagcucaccuggaacgaccugauccggcugugcaucauggucggcgccaacgccuccgaccgcauggggaugggcaccacguaccucgcccugauggccaccuucaagaugcgcccgauguucgcgguggggcuccuguuccggcgccugaccagccgggaggugcugcuccugaccaucgggcugucccucgucgccagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgcguggaagaccauggccaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgcgggcggcaugcucaucgccugcuacgucaucuccgggagcuccgccgaccugagccuggagaaggccgccgagguguccugggaggaggaggcggagcacagcggcgccucccacaacauccucguggagguccaggacgacgggaccaugaagaucaaggacgaggagcgggacgacacgcugaccauccugcucaaggccacccugcuggccgugagcggcguguacccgcucuccauccccgccacccuguucgucugguacuucuggcagaagaagaagcagcgcagcggggugcugugggacacccccagcccgcccgagguggagcgggcgguccucgacgacggcaucuaccgcaucaugcagcggggccugcuggggcgcagccaggugggcgugggggucuuccaggagaacguguuccacacgauguggcacgugacccggggcgccguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagaccgcccccgggacguucaagaccuccgagggcgaggucggcgcgaucgcccucgacuucaagcccgggaccagcggcagccccaucgugaaccgcgaggggaagaucgugggccuguacggcaacggggucgugaccacguccggcaccuacgugagcgccaucgcccaggcgaaggccucccaggaggggccccugccggagaucgaggacgaggucuuccggaagcgcaaccucaccaucauggaccugcaccccggcagcgggaagacccggcgcuaccugcccgccaucgugcgggaggccaucaagcgcaagcuccggacgcugauccuggccccgacccgcguggucgcguccgagauggccgaggcccucaagggcaugcccauccgcuaccagaccaccgccgucaagagcgagcacacgggcaaggagaucguggaccugaugugccacgccaccuucaccaugcggcugcucucccccguccgcgugcccaacuacaacaugaucaucauggacgaggcgcacuucaccgacccgagcuccaucgccgcccggggguacaucagcacgcgcgugggcaugggggaggccgccgcgaucuucaugaccgccacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgcgaacugccugcggaagaacgggaagcgcgugauccagcugucccggaagaccuucgacaccgaguaccagaagaccaagaacaacgacugggacuacguggucacgaccgacaucagcgagaugggcgccaacuuccgcgccgaccgggugaucgacccccgccggugccucaagccggugauccugaaggacgggcccgagcgcgucauccuggccggccccaugcccgugaccgucgccuccgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcgcuccgggaguucaaggaguucgccgccggccgccggagcgucuccggggaccugauccuggagaucggcaagcucccccagcaccugacgcagcgcgcccagaacgcgcuggacaaccucgugaugcugcacaacagcgagcagggcgggcgggccuaccgccacgccauggaggagcugccggacaccaucgagacccucaugcugcuggcccucaucgccgugcugaccggcggggucacgcuguucuuccucuccggccgggggcugggcaagaccagcaucggccugcucugcgugauggcguccagcgugcugcuguggauggccuccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagaccacgaagaaggaccuggggaucggccacguggccgucgagaaccaccaccacgccgccaugcuggacguggaccuccaccccgcguccgccuggacccuguacgccguggccaccaccaucaucacgcccaugaugcgccacaccaucgagaacaccaccgccaacaucagccugacggcgaucgccaaccaggccgccauccucauggggcuggacaagggcuggccgaucuccaagauggacaucggcgucccccugcucgcgcuggggugcuacagccaggugaacccccugacccucaccgccgccgugcugaugcuggucgcccacuacgccaucaucggccccgggcuccaggcgaaggccacccgggaggcccagaagcgcacggccgccggcaucaugaagaacccgaccguggacgggaucguggcgaucgaccuggaccccgucguguacgacgccaaguucgagaagcagcugggccagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggcgaacaucuuccgggggagcuaccucgccggcgccggccuggccuucucccugaugaagucccucgggggcgggcgccggggcaccggggcgcagggcgagacgcugggcgagaaguggaagcgccagcugaaccagcucuccaagagcgaguucaacaccuacaagcgguccgggaucauggaggucgaccgcagcgaggccaaggagggccugaagcgcggggagaccaccaagcacgccgugucccgcggcacggccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggcgaccuacggguggaaccuggugaagcuccacuccggcaaggacguguucuucaucccgcccgagaagugcgacacgcugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacccuggagcagaugcagcggcgccacggcggcaugcuggugcggaacccccucucccgcaacagcacgcacgagauguacuggguguccugcgggaccggcaacaucgucagcgccgugaacaugaccucccggaugcugcugaaccgcuucaccauggcccaccgcaagccgaccuacgagcgggacguggaccucggggccggcacgcgccacgucgccguggagcccgagguggcgaaccuggacaucaucggccagcggaucgagaacaucaagcacgagcacaagagcaccuggcacuacgacgaggacaaccccuacaagaccugggccuaccacggguccuacgaggucaagcccagcggcagcgccuccagcauggugaacggggucgugaagcugcucaccaagccgugggacgugauccccauggucacgcagaucgccaugaccgacaccacccccuucggccagcagcgcguguucaaggagaagguggacacgcggacccccaaggccaagcgcgggaccgcgcagaucauggaggucaccgccaaguggcuguggggcuuccugucccggaacaagaagccgcgcaucugcacgcgggaggaguucacccgcaaggugcggagcaacgccgccaucggcgcgguguucgucgacgagaaccaguggaacuccgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgcgaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacgcgcaucaccgaggacgaccugcagaacgaggcgaagaucaccgacaucauggagcccgagcacgcccugcucgccaaguccaucuucaagcugaccuaccagaacaaggugguccgggugcagcgcccggccaagaacgggacggugauggacgucaucagccgccgggaccagcgcggcuccggccaggugggcaccuacggccugaacaccuucaccaacauggaggcccagcucauccggcagauggagagcgaggggaucuucucccccagcgagcuggagacgcccaaccuggcgggccgcgugcucgacuggcuggagaagcacggggucgagcggcugaagcgcauggccaucuccggcgacgacugcguggugaagcccaucgacgaccgguucgccaccgcccucaccgcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcgcgcgugucccagggcgccggguggagccugcgggagaccgccugccugggcaaguccuacgcccagauguggcagcucauguacuuccaccgccgggaccugcgccuggcggccaacgccaucugcagcgccgucccgguggacugggugcccacgucccggaccaccuggagcauccacgcccaccaccaguggaugaccacggaggacaugcucuccgucuggaaccgcguguggaucgaggagaaccccuggauggaggacaagacccacaucagcuccuggggcgacgugcccuaccugggcaagcgggaggaccaguggugcggcagccugaucgggcucaccgcgcgcgccaccugggccacgaacauccaggucgccaucaaccaggugcgccggcugaucggcaacgagaacuaccuggacuacaugaccuccaugaagcgcuucaagaacgagagcgacccggagggggcccucugguga

SEQ ID NO: 8598 - RNA, 9879 nt, Artificial Sequence
  derived and/or modified CDS sequence (opt1) from DENV-1__GQ199856__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucguggccauggaccugggggaguucugcgaggacacgaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggucacccccuccauggccaugcggugcgugggcaucggcagccgcgacuucguggaggggcuguccggcgccacgugggucgacguggugcucgagcacgggagcugcgucaccaccauggccaaggacaagcccacccuggacaucgagcugcucaagacggaggugaccaaccccgcggugcugcggaagcugugcaucgaggccaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaucacgugcgccaaguucaagugcgucaccaagcucgagggcaagaccgugcaguacgagaaccugaaguacagcgugaucgucaccgugcacacgggcgaccagcaccaggucgggaacgaguccaccgagcacggcaccaccgcgaccaucacgccccaggcccccagcaccgagauccagcugaccgacuacggggcccucacccuggacugcagcccccgcacgggccuggacuucaacgagauggugcuccugaccaugaaggagaaguccuggcuggugcacaagcagugguuccucgaccugccgcugcccuggaccagcggggccuccaccagccaggagacguggaaccggaaggaccuccuggucaccuucaagaccgcccacgcgaagaagcaggagguggugguccugggcucccaggagggcgccaugcacaccgcccucacgggggccaccgagauccagaccagcggcaccacgaccaucuucgccgggcaccugaagugccgccugaagauggacaagcucacccugaagggcauguccuacgugaugugcaccgggagcuucaagcuggagaaggagguggcggagacgcagcacggcaccguccucgugcagaucaaguacgagggcaccgacgcccccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgcuccaccagccuguccaugaccugcaucgccgucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucaucgggcagcucacguggaacgaccugauccggcugugcaucauggugggcgcgaacgccuccgaccgcauggggaugggcaccaccuaccucgcccugauggccaccuucaagaugcgcccgauguucgccgugggccuccuguuccggcgccugacgagccgggagguccugcuccugaccaucgggcugucccucguggcgagcgucgagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgauggugcuguccaucgugagccuguucccccucugccuguccacgaccagccagaagaccaccuggcugcccguccuccugggcucccuggggugcaagccgcucacgauguuccugaucgccgagaacaagaucuggggccgccggagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggaccaugaagaucaaggacgaggagcgcgacgacacccugaccauccugcucaaggccacccugcuggccgugagcggcgucuacccgcucuccauccccgccacgcuguucgugugguacuucuggcagaagaagaagcagcggagcggggugcugugggacacccccagcccgcccgaggucgagcgcgccgugcucgacgacggcaucuaccggaucaugcagcgcggccugcuggggcggagccaggugggcgucgggguguuccaggagaacguguuccacaccauguggcacgucacccgcggcgcggugcugauguaccaggggaagcggcucgagcccuccugggccagcgugaagaaggaccugaucuccuacggcggcggguggcgccugcagggcagcuggaacacgggggaggagguccaggugaucgccguggagcccggcaagaaccccaagaacguccagaccgcccccgggaccuucaagaccuccgagggcgaggugggcgccaucgcgcucgacuucaagcccgggacgagcggcagccccaucgugaaccgggaggggaagaucgucggccuguacggcaacgggguggugaccaccuccggcaccuacgucagcgccaucgcccaggccaaggcgucccaggaggggccccugccggagaucgaggacgagguguuccgcaagcggaaccucacgaucauggaccugcaccccggcagcgggaagacccgccgguaccugcccgccaucgugcgcgaggccaucaagcggaagcuccgcacccugauccuggccccgacccgcgucguggccuccgagauggcggaggcccucaagggcaugcccauccgguaccagacgaccgccgucaagagcgagcacaccggcaaggagaucgucgaccugaugugccacgccaccuucacgaugcgccugcucucccccgugcgggugcccaacuacaacaugaucaucauggacgaggcccacuucaccgacccgagcuccaucgcggcccgcggguacaucagcacccgggucggcaugggggaggccgccgccaucuucaugaccgcgacgccgcccggcuccguggaggccuucccccagagcaacgccgugauccaggacgaggagcgcgacaucccggagcgguccuggaacagcggguacgaguggaucaccgacuuccccggcaagaccgucugguucgugcccuccaucaagagcggcaacgacaucgccaacugccugcgcaagaacgggaagcgggugauccagcugucccgcaagaccuucgacacggaguaccagaagaccaagaacaacgacugggacuacgucgugaccaccgacaucagcgagaugggcgcgaacuuccgggccgaccgcgugaucgacccccggcgcugccucaagccggucauccugaaggacgggcccgagcgggugauccuggccggccccaugcccgucacgguggccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccgccugcggggcgaggcccgcaagaccuucguggagcugaugcggcgcggggaccucccggucuggcugagcuacaagguggccuccgagggcuuccaguacagcgaccggcgcuggugcuucgacggcgagcggaacaaccaggugcuggaggagaacauggacgucgagaucuggacgaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacgcucaugcugcuggcccucaucgccguccugaccggcggggugacccuguucuuccucuccggccgcgggcugggcaagaccagcaucggccugcucugcgugauggccuccagcguccugcuguggauggcguccguggagccccacuggaucgccgccagcaucauccucgaguucuuccugauggugcugcucauccccgagcccgaccggcagcgcaccccgcaggacaaccagcuggccuacgucgugaucgggcuccucuucaugauccugacgguggccgcgaacgagaugggccugcucgagaccaccaagaaggaccuggggaucggccacgucgccguggagaaccaccaccacgccgccaugcuggacguggaccuccaccccgccuccgcguggacccuguacgccgucgccacgaccaucaucacccccaugaugcggcacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgcgaggcccagaagcgcaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcggaccaccugggcccugugcgagagcaucacccucgccacgggcccccugaccacccugugggaggggucccccggcaaguucuggaacaccacgaucgccgucagcauggccaacaucuuccgcgggagcuaccucgcgggcgccggccuggccuucucccugaugaagucccucgggggcgggcggcgcggcaccggggcccagggcgagacccugggcgagaaguggaagcggcagcugaaccagcucuccaagagcgaguucaacaccuacaagcgcuccgggaucauggagguggaccggagcgaggcgaaggagggccugaagcgcggggagacgaccaagcacgccgugucccggggcaccgccaagcugcgcugguucgucgagcggaacuucgugaagccggaggggaaggugaucgaccucggcugcggccgcgggggcuggagcuacuacugcgccgggcugaagaaggucaccgaggugaagggcuacacgaagggcgggcccggccacgaggagcccauccccauggccaccuacggguggaaccuggugaagcugcacuccggcaaggacgucuucuucaucccgcccgagaagugcgacacccuccugugcgacaucggggagagcucccccaaccccaccaucgaggagggccggacgcugcgcgugcucaagaugguggagccguggcugcgggggaaccaguucugcaucaagauccugaaccccuacaugcccagcgucguggagacccucgagcgcaugcagcggaagcacggcggcaugcuggugcgcaacccccugucccggaacagcacccacgagauguacugggucuccugcgggaccggcaacaucgugagcgcggugaacaugaccucccgcaugcuccugaaccgcuucacgauggcccaccggaagccgaccuacgagcgcgacgucgaccugggggccggcacccggcacguggccguggagcccgaggucgccaaccucgacaucaucggccagcgcaucgagaacaucaagcacgagcacaagcugaccuggcacuacgacgaggacaaccccuacaagacgugggcguaccacgggagcuacgaggugaagcccuccggcagcgccagcuccauggucaacgggguggugaagcugcucaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcgaaguggcuguggggcuuccugagccgcaacaagaagccgcggaucugcacccgcgaggaguucacccggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgccacgugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucaccgaggacgaccugcagaacgaggccaagaucacggacaucauggagcccgagcacgcgcugcucgccaagagcaucuucaagcugaccuaccagaacaaggucgugcgcgugcagcgcccggccaagaacgggaccgucauggacgugaucucccggcgcgaccagcggggcagcggccaggugggcaccuacggccugaacacguucaccaacauggaggcccagcucauccgccagauggaguccgaggggaucuucagccccuccgagcuggagacccccaaccuggccggccggguccucgacuggcuggagaagcacgggguggagcgccugaagcggauggcgaucagcggcgacgacugcguggucaagcccaucgacgaccgcuucgccaccgcccucacggcccugaacgacauggggaaggugcggaaggacaucccgcagugggagcccuccaagggcuggaacgacuggcagcagguccccuucugcagccaccacuuccaccagcugaucaugaaggacggccgcgagaucgucgugcccugccggaaccaggacgagcucguggggcgcgcccgggucagccagggcgcgggguggucccugcgcgagaccgccugccugggcaagagcuacgcccagauguggcagcucauguacuuccaccggcgcgaccugcggcuggccgcgaacgccaucugcuccgccgugccgguggacuggguccccaccagccgcaccacgugguccauccacgcccaccaccaguggaugaccaccgaggacaugcucagcguguggaaccggguguggaucgaggagaaccccuggauggaggacaagacccacaucuccagcuggggcgacguccccuaccugggcaagcgcgaggaccaguggugcggcucccugaucgggcucacggcccgcgcgaccugggccaccaacauccagguggccaucaaccaggugcggcgccugaucggcaacgagaacuaccuggacuacaugaccagcaugaagcgguucaagaacgaguccgacccggagggggcccucugguga

SEQ ID NO: 8599 - RNA, 9879 nt, Artificial Sequence
  derived and/or modified CDS sequence (opt1) from DENV-1__FJ898427__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacugcgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugacgauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacgcugauccuggcccccacccgcgugguggccuccgagauggccgaggcgcucaagggcaugcccauccgcuaccagaccaccgccgucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacgcagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugaccggcggggugacccuguucuuccucuccggccgggggcugggcaagacgagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccuccgccuggacccuguacgccguggcgaccacgaucaucaccccgaugaugcgccacaccaucgagaacaccacggccaacaucagccugaccgccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacgcgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcacgaccugggcccugugcgagagcaucacccucgcgaccggcccccugacgacccugugggagggguccccgggcaaguucuggaacaccaccaucgccgugagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcacggcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacgcacgagauguacuggguguccugcgggaccggcaacaucgugagcgccgucaacaugaccucccggaugcugcugaaccgcuucaccauggcccaccgcaagcccacguacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacacggccggcugggacacccgcaucaccgaggacgaccugcagaacgaggccaagaucaccgacaucauggagccggagcacgcccugcucgccacguccaucuucaagcugaccuaccagaacaagguggugcggguccagcgccccgcgaagaacgggaccgugauggacgugaucagccgccgggaccagcgcggcuccgggcaggucggcaccuacggccugaacacguucaccaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcgcugacggcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggaccacgugguccauccacgcccaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccacgugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8600 - RNA, 9879 nt, Artificial Sequence
  derived and/or modified CDS sequence (opt1) from DENV-1__JF937599__SS-prME
agcgugaccaugcugcucaugcugaugcccaccgcccuggccuuccaccucaccgcccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucaccgaggccgagcccgacgacguggacugcuggugcaacgccaccgacaccugggugacguacgggaccugcagccagaccggcgagcaccggcgggacaagcgguccguggcgcuggcgccccacgugggccucgggcuggagacccgcacggagaccuggaugagcuccgagggcgccuggaagcagauccagcggguggagaccugggcccugcgccaccccggguucaccgugaucgcccuguuccuggcccacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggcgaaggacaagcccacccuggacaucgagcugcucaagaccgaggucacgaaccccgccgugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgcgaaguucaagugcgugacgaagcucgagggcaagaucguccaguacgagaaccugaaguacagcgugaucgugaccguccacaccggcgaccagcaccagguggggaacgaguccaccgagcacggcacgaccgccaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccccugcccuggacgagcggggccuccaccagccaggagaccuggaaccggcaggaccuccuggugaccuucaagacggcgcacgccaagaagcaggaggucguggugcugggcucccaggagggcgccaugcacaccgcccucaccggggccaccgagguccagacgagcggcaccaccaccaucuucgcggggcaccugaagugccgccugaagauggacaagcucacgcugaagggcauguccuacgugaugugcaccgggagcuucaagcuggagaaggagguggccgagacccagcacggcaccguccucgugcagaucaaguacgagggcacggacgcccccugcaagauccccuucuccacccaggacgagaagggggugacccagaacggccggcugaucaccgccaacccgaucgucacggacaaggagaagcccgugaacaucgaggcggagccgcccuucggggagagcuacaucgugaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcgucuucaccuccguggggaagcuggugcaccagaucuucggcacggccuacgggguccuguucagcggcguguccuggaccaugaagaucgggaucggcgugcuccugaccuggcugggccucaacagccgcuccaccagccuguccaugacgugcaucgccgucgggcuggugacccucuaccugggcgugaugguccaggcggacagcgggugcgugaucaacuggaagggccgggagcugaagugcgggagcggcaucuucgugaccaacgagguccacaccuggacggagcaguacaaguuccaggccgacuccccgaagcgccucagcgccgccaucggcaaggccugggaggagggggugugcggcauccgguccgcgacccgccuggagaacaucauguggaagcagaucagcaacgagcugaaccacauccuccuggagaacgacaugaagcugaccguggucgugggggacguggccggcauccucgcccaggggaagaagaugauccggccccagcccauggaguacaaguacuccuggaaguccuggggcaaggccaagaucaucggcgcggacguccagaacaccaccuucaucaucgacgggcccaacacgccggagugccccgacgaccagcgcgccuggaacaucugggagguggaggacuacggcuucgggaucuucaccaccaacaucuggcugaagcugcgggacuccuacacccaggugugcgaccaccgccucaugagcgccgccaucaaggacuccaaggccguccacgcggacaugggcuacuggaucgagagcgagaagaacgagacguggaagcuggcccgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugacgggcacccuggcggucuucuuccugcucaucauggggcagcugaccuggaacgaccugauccggcucugcaucauggugggcgccaacgccuccgaccgcauggggaugggcaccacguaccuggcccugauggccaccuucaagaugcgcccgauguucgcggugggccuccuguuccggcgccugaccagccgggagguccuccugcugaccaucgggcucucccugguggccagcgucgagcugcccaacucccucgaggagcugggcgacgggcuggccaugggcaucaugauccucaagcugcugacggacuuccagagccaccagcucugggccacccugcugucccucaccuucauccgcaccacguucagccugcacuacgcguggaagaccauggccauggugcuguccaucgugagccucuucccccugugccuguccaccaccagccagaagacgaccuggcuccccguccugcugggcucccucgggugcaagccgcugaccauguuccugaucgccgagaacaagaucuggggccgcaagagcuggccccucaacgaggggaucauggccgugggcaucgugagcauccugcuguccagccuccugaagaacgacgucccccuggccgggccccucaucgcgggcggcaugcugaucgccugcuacgugaucuccgggagcuccgccgaccugagccucgagaaggccgccgagguguccugggaggaggaggcggagcacagcggcgccucccacaacauccuggucgaggugcaggacgacgggaccaugaagaucaaggacgaggagcgcgacgacacgcugaccauccuccugaaggccacccugcucgccgugagcggcgucuacccgcuguccauccccgccacccuguucgugugguacuucuggcagaagaagaagcagcggagcggggugcucugggacacccccagcccgcccgaggucgagcgcgcggugcuggacgacggcaucuaccggaucaugcagcgcggccugcuggggcggagccaggugggcgucgggguguuccaggagaacguguuccacacgauguggcacgucacccgcggcgccgugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaaccccaagaacguccagaccgcccccgggacguucaagaccuccgagggcgaggugggcgcgaucgcccuggacuucaagcccgggaccagcggcagccccaucgugaaccgggaggggaagaucgucggccuguacggcaacgggguggugaccacguccggcaccuacgucagcgccaucgcccaggcgaaggccucccaggaggggccccucccggagaucgaggacgagguguuccgcaagcggaaccugaccaucauggaccugcaccccggcagcgggaagacccgccgguaccuccccgccaucgugcgcgaggccaucaagcggcgccugcgcacgcugauccucgccccgacccgggucguggcguccgagauggccgaggcccugaagggcaugcccauccgcuaccagaccaccgccgucaagagcgagcacacgggcaaggagaucgucgaccugaugugccacgccaccuucaccaugcggcuccugucccccgugcgcgugcccaacuacaacaugaucaucauggacgaggcgcacuucaccgacccgagcuccaucgccgcccggggguacaucagcacgcgcgucggcaugggggaggccgccgcgaucuucaugaccgccacgccgcccggcuccguggaggccuucccccagagcaacgccgugauccaggacgaggagcgggacaucccggagcgcuccuggaacagcggguacgaguggaucaccgacuuccccggcaagacggucugguucgugcccuccaucaagagcggcaacgacaucgcgaacugccugcggaagaacgggaagcgcgugauccagcucucccggaagaccuucgacaccgaguaccagaagaccaagaacaacgacugggacuacgucgugacgaccgacaucagcgagaugggcgccaacuuccgcgccgaccgggugaucgacccccgccggugccugaagccggucauccugaaggacgggcccgagcgcgugauccucgccggccccaugcccgucaccguggccuccgcggcccagcggcgcgggcggaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgcgagaaguccgcggccaucgacggggaguaccggcugcgcggcgaggcccggaagaccuucguggagcucaugcgccgcggggaccugccggucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcgcugcgggaguucaaggaguucgccgccggccgccggagcguguccggggaccugauccucgagaucggcaagcugccccagcaccugacgcagcgcgcccagaacgcgcucgacaaccuggugaugcugcacaacagcgagcagggcgggcgggccuaccgccacgccauggaggagcucccggacaccaucgagacccugaugcugcucgcccugaucgccguccugaccggcggggugacccucuucuuccuguccggccgggggcugggcaagaccagcaucggccuccugugcgugauggcguccagcguccugcucuggauggccuccguggagccccacuggaucgccgccagcaucauccuggaguucuuccugauggugcuccugauccccgagcccgaccgccagcggaccccgcaggacaaccagcuggccuacgucgugaucgggcuccuguucaugauccugaccguggcggccaacgagaugggccuccuggagaccacgaagaaggaccuggggaucggccacgucgccguggagaaccaccaccacgccgccaugcucgacguggaccugcaccccgcguccgccuggacccuguacgccgucgccaccaccaucaucacgcccaugaugcgccacaccaucgagaacaccaccgccaacaucagccucacggcgaucgccaaccaggccgccauccugauggggcuggacaagggcuggccgaucuccaagauggacaucggcgugccccuccuggcgcuggggugcuacagccaggugaacccccucacccugaccgccgccguccugaugcucguggcccacuacgccaucaucggccccgggcugcaggcgaaggccacccgcgaggcccagaagcggacggccgccggcaucaugaagaacccgaccguggacgggaucgucgcgaucgaccuggaccccgugguguacgacgccaaguucgagaagcagcucggccagaucaugcugcugauccucugcaccucccagauccugcugaugcgcaccacgugggcccucugcgagagcaucacccuggccaccggcccccugaccacgcucugggaggggucccccggcaaguucuggaacaccaccaucgccgucagcauggcgaacaucuuccgggggagcuaccuggccggcgccggccuggccuucucccucaugaagucccucgggggcgggcgccgggggaccggggcgcagggcgagacgcugggcgagaaguggaagcgccagcucaaccagcuguccaagccggaguucaacaccuacaagcggagcgggaucauggagguggaccgcuccgaggccaaggagggccugaagcgcggggagaccaccaagcacgccgugagccgcggcacggccaagcuccggugguucgucgagcgcaaccuggugaagcccgaggggaaggugaucgaccugggcugcggccgcggcgggugguccuacuacugcgccgggcugaagaaggucaccgaggugaagggguacaccaagggcgggcccggccacgaggagcccaucccgauggcgaccuacggguggaaccucgugaagcugcacagcggcaaggacgucuucuucaucccgcccgagaagugcgacacgcugcucugcgacaucggggaguccagccccaacccgaccaucgaggagggccgcacccugcgggugcugaagaugguggagcccuggcuccgcgggaaccaguucugcaucaagauccugaaccccuacaugcccuccgucguggagacccuggagcagaugcagcggaagcacggcggcaugcucgugcgcaacccgcugagccggaacuccacgcacgagauguacugggucagcugcgggaccggcaacaucguguccgccgugaacaugaccagccgcaugcugcucaaccgcuucaccauggcccaccggaagcccaccuacgagcgcgacgucgaccugggggccggcacgcggcacguggccguggagcccgaggucgcgaaccuggacaucaucggccagcgcaucgagaacaucaagcacgagcacaaguccaccuggcacuacgacgaggacaaccccuacaagaccugggccuaccacgggagcuacgaggugaagccguccggcagcgccagcuccauggucaacgggguggugaagcuccugaccaagcccugggacgucauccccauggugacgcagaucgccaugaccgacaccacccccuucggccagcagcggguguucaaggagaaggucgacacgcgcaccccgaaggccaagcgggggaccgcgcagaucauggaggugaccgccaaguggcuguggggcuuccucagccgcaacaagaagccccggaucugcacgcgcgaggaguucacccggaaggugcgcuccaacgccgccaucggcgcggucuucguggacgagaaccaguggaacagcgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggucccgggcgaucugguacauguggcugggcgcccgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacgcggaucaccgaggacgaccugcagaacgaggcgaagaucaccgacaucauggagccggagcacgcccuccuggccaagagcaucuucaagcugaccuaccagaacaaggucgugcgcgugcagcgccccgccaagaacgggacggucauggacgugaucucccggcgcgaccagcggggcagcggccaggugggcaccuacggccucaacaccuucaccaacauggaggcccagcugauccgccagauggaguccgaggggaucuucagccccuccgagcuggagacgcccaaccucgcgggccggguccuggacuggcuggagaagcacgggguggagcgccucaagcggauggccaucagcggcgacgacugcguggucaagccgaucgacgaccgcuucgccaccgcccugaccgcccugaacgacauggggaaggugcggaaggacaucccccagugggagcccuccaagggcuggaacgacuggcagcagguccccuucugcagccaccacuuccaccagcucaucaugaaggacggccgcgagaucgucgugccgugccggaaccaggacgagcugguggggcgcgcgcgggucagccagggcgccggguggucccugcgcgagaccgccugccucggcaagagcuacgcccagauguggcagcugauguacuuccaccggcgcgaccugcggcucgcggccaacgccaucugcuccgccgugcccguggacuggguccccacgagccgcaccaccugguccauccacgcccaccaccaguggaugaccacggaggacaugcugagcguguggaaccggguguggaucgaggagaaccccuggauggaggacaagacccacgucuccagcuggggcgacgugccguaccugggcaagcgcgaggaccaguggugcggcucccucaucgggcugaccgcgcgcgccaccugggccacgaacauccagguggccaucaaccagguccggcgccugcucggcaacgagaacuaccuggacuacaugaccagcaugaagcgguucaagaacgaguccgaccccgagggggcccugugguga

SEQ ID NO: 8601 - RNA, 9879 nt, Artificial Sequence
  derived and/or modified CDS sequence (opt1) from DENV-1__FJ898431__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccgugcuguuccugcucaucauggggcagcugacguggaacgaccugauccggcucugcaucauggucggcgcgaacgccuccgaccgcauggggaugggcaccaccuaccuggcccugauggccaccuucaagaugcgcccgauguucgccgugggccuccuguuccggcgccugacgagccgggaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacccugcugucccucacguucaucaagaccaccuucagccugcacuacgccuggaagaccauggcgaugguccuguccaucgugagccucuucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgggacgacacccugaccauccuccugaaggccacccugcucgccgugagcggcguguacccgcuguccauccccgccacgcuguucgucugguacuucuggcagaagaagaagcagcgcagcggggugcucugggacacccccagcccgcccgagguggagcgggccguccuggacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacacgggggaggaggugcaggucaucgccguggagcccggcaagaaccccaagaacgugcagaccgcccccgggaccuucaagaccuccgagggcgaggucggcgccaucgcgcuggacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccucccggagaucgaggacgaggucuuccggaagcgcaaccugacgaucauggaccugcaccccggcagcgggaagacccggcgcuaccuccccgccaucgugcgggaggccaucaagcgcaagcugcggacccugauccucgccccgacccgcguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagaccuucgacacggaguaccagaagaccaagaacaacgacugggacuacguggucaccaccgacaucagcgagaugggcgcgaacuuccgcgccgaccgggugaucgacccccgccggugccugaagccggugauccugaaggacgggcccgagcgcgucauccucgccggccccaugcccgugacggucgccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggacgaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucacccccaugaugcgccacaccaucgagaacacgaccgccaacaucagccucaccgccaucgcgaaccaggccgccauccugauggggcuggacaagggcuggccgaucuccaagauggacaucggcgucccccuccuggcccuggggugcuacagccaggugaacccccucacccugacggcggccgugcugaugcucgucgcccacuacgccaucaucggccccgggcugcaggccaaggcgacccgggaggcccagaagcgcaccgccgccggcaucaugaagaacccgaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggaggggucccccggcaaguucuggaacaccacgaucgccgugagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccaccaucgaggagggccgcacgcugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggaccggcaacaucgucagcgcggugaacaugaccucccgcaugcugcucaaccgguucacgauggcccaccgcaagccgaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcuccugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccucucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcgcuccuggccaaguccaucuucaagcugaccuaccagaacaaggugguccgcgugcagcggccggccaagaacgggaccgugauggacgucaucagccgccgcgaccagcggggcuccggccaggugggcaccuacggccucaacacguucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccaccgcccugacggcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugcccuaccugggcaagcgcgaggaccaguggugcggcagccucaucgggcugacggcccgggcgaccugggccaccaacauccaggucgccaucaaccaggugcgccgccugaucggcaacgagaacuaccucgacuacaugaccuccaugaagcgguucaagaacgagagcgacccggagggggcccugugguga

SEQ ID NO: 8602 - RNA, 9879 nt, Artificial Sequence
  derived and/or modified CDS sequence (opt1) from DENV-1__GU131678__SS-prME
agcgugaccaugcugcucaugcugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcaugaccaagcuggagggcaagaucgugcaguacgagaaccucaaguacagcgucaucgugaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcugguccacaagcagugguuccuggaccucccgcugcccuggaccagcggggccagcaccucccaggagacguggaaccggcaggaccugcucgugaccuucaagaccgcccacgcgaagaagcaggagguggucgugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucaaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggugcaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgccuggaacaucugggaggucgaggacuacggcuucgggaucuucaccaccaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccguggucguggacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgucaaggagaaggaggagaaccucgucaagagcauggugagcgccggcuccggcgaggucgacagcuuccugcuggggcuccugugcaucuccaucaugaucgaggaggugaugcggagccgcuggucccggaagaugcugaugaccggcacccucgccguguucuuccugcugaucauggggcagcucaccuggaacgaccugauccgccugugcaucauggucggcgccaacgcgagcgaccgcauggggaugggcacgaccuaccucgcccugauggccaccuucaagaugcggccgauguucgccguggggcuccuguuccgccggcugaccucccgcgaggugcugcuccugacgaucgggcugagccucgucgccuccguggagcugcccaacagccuggaggagcucggcgacgggcuggcgaugggcaucaugauccugaagcuccugaccgacuuccaguccuaccagcugugggccacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgcggagaacaagaucuggggccggaaguccuggccccugaacgaggggaucauggccgucggcaucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggacgaugaagaucaaggacgaggagcgcgacgacacccugaccauccugcucaaggcgacccugcuggccguguccggcguguacccgcucagcauccccgccacccuguucgucuggcacuucuggcagaagaagaagcagcgguccggggugcugugggacacgcccagcccgcccgagguggagcgcgccguccuggacgacggcaucuaccggaucaugcagcgcggccuccuggggcggucccaggugggcgugggggucuuccaggagaacguguuccacaccauguggcacgugacccgcggcgccguccugauguaccaggggaagcggcucgagcccagcugggcguccgugaagaaggaccugaucagcuacggcggcggguggcgcuuccagggcuccuggaacaccggggaggaggugcaggucaucgccguggagcccggcaagaaccccaagaacgugcagacggcccccgggaccuucaagacccccgagggcgaggucggcgccaucgcccuggacuucaagcccgggaccagcggcucccccaucgugaaccgggaggggaagaucgugggccucuacggcaacggggucgugacgaccagcggcaccuacgugagcgcgaucgcccaggccaaggccucccaggaggggccgcugcccgagaucgaggacgaggucuuccgcaagcggaaccugaccaucauggaccuccaccccggcagcgggaagacgcgccgguaccugccggcgaucgugcgcgaggccaucaagcggaagcugcgcacccucauccuggcccccacccgcguggucgccuccgagauggccgaggcgcugaagggcaugcccauccgguaccagaccacggccgucaagagcgagcacaccggcaaggagaucguggaccucaugugccacgccaccuucaccaugcgccugcugucccccguccgggugccgaacuacaacaugaucaucauggacgaggcccacuucacggaccccagcuccaucgccgcgcgcggguacaucagcacccgggugggcaugggggaggccgccgccaucuucaugaccgccacgccgcccggcuccauggaggcguucccgcagagcaacgccgucauccaggacgaggagcgcgacauccccgagcgguccuggaacagcggguacgaguggaucacggacuuccccggcaagaccgugugguucgugcccuccaucaaggccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgcgaacuuccgggccgaccgcgucaucgacccgcggcgcugccugaagcccgugauccucaaggacgggcccgagcgggugauccuggccggccccaugccggucaccguggccagcgccgcgcagcgccgggggcgcaucggccggaaccccaacaaggagggcgaccaguacaucuacauggggcagccccugaacaacgacgaggaccacgcccacuggacggaggccaagaugcuccuggacaacaucaacacccccgagggcaucaucccggcccuguucgagcccgagcgcgagaaguccgccgcgaucgacggggaguaccgccuccggggcgaggcccgcaagaccuucgucgagcugaugcggcgcggggaccugcccguguggcucagcuacaagguggccuccgagggcuuccaguacagcgaccggcgcuggugcuucgccggcgagcggaacaaccagguccuggaggagaacauggacguggagaucuggaccaaggagggggagcgcaagaagcugcucccccgguggcuggacgcccgcacguacagcgacccgcuggcgcuccgggaguucaaggaguucgccgccggccgccgguccgugagcggggaccugauccuggagaucggcaagcucccccagcaccugacccagcgcgcccagaacgcgcuggacaaccucgucaugcugcacaacuccgagcagggcgggcgggccuaccgccacgccauggaggagcugcccgacaccaucgagacccucaugcugcuggcccucaucgccgugcugacgggcggggugacccuguucuuccucagcggcaaggggcugggcaagaccuccaucggccugcucugcgucauggcgagcuccgugcugcuguggauggggagcguggagccccacuggaucgccgccuccaucauccucgaguucuuccugaugguccugcucaucccggagcccgaccggcagcgcacgccccaggacaaccagcuggccuacguggugaucggccuccuguucaugauccugaccgucgccgcgaacgagauggggcugcucgagacgaccaagaaggaccugggcaucgggcacguggccguggagaaccaccaccacgccgccaugcuggacgucgaccuccacccggccagcgcguggacccuguacgccguggccaccacgaucaucacccccaugaugcggcacaccaucgagaacaccacggccaacaucucccugaccgccaucgcgaaccaggccgccauccucaugggccuggccaagggcuggcccaucagcaagauggacaucggggugccccugcucgcgcugggcugcuacucccaggucaacccgcugacccucaccgccgccgugcugaugcugguggcccacuacgccaucaucgggcccggccuccaggcgaaggccacgcgcgaggcccagaagcggaccgccgccgggaucaugaagaaccccaccaucgacggcaucgucgcgaucgaccuggaccccgugguguacgacgccaaguucgagaagcagcugggccagaucaugcuccugauccugugcaccagccagauccuccugaugcgcacgaccugggcccugugcgaguccaucacccucgccaccgggccgcugacgacccugugggagggcagccccgggaaguucuggaacaccaccaucgccgucuccauggcgaacaucuuccgcggcagcuaccucgccggcgccgggcuggccuucucccugaugaagucccucggcgggggccggcgcgggacgggcgcgcagggcgagacccugggggagaaguggaagcggcagcugaaccagcucagcaaguccgaguucaacaccuacaagcgcagcggcaucauggagguggaccgguccgaggccaaggaggggcugaagcgcggcgagaccacgaagcacgccgugagccgggggcccgccaagcugcgcugguucgucgagcggacccuggugaaccccgagggcaaggugaucgcccucggcugcgggcgcggcgcgugguccuacuacugcgccgggcugaagaagggcaccgaggucaagggguacaccaagggcggcccggggcacgaggagcccauccccauggccacguacggcugggaccuggugaagcuccacagcgggaaggacguguucuucaucccgcccgagaagugcgacacccugcugugcgacaucggcgaguccagccccaaccccaccaucgaggaggggcggacccuccgcguccugaagaugguggagcccuggcugcggggcaaccaguucugcaucaagauccucaaccccuacaugcccuccguggucgagacgcuggagcagaugcagcgcaagcacggcgggaugcuggugcggaacccccucagccgcaacuccacccacgagauguacugggugagcugcggcaccgggaacaucgucuccgccgugaacaugaccagccggaugcugcugaaccgcuucaccauggcccaccggaagcccacguacgagcgcgacguggaccucggcgcgggcacccgccacgucgccguggacccggagguggccaaccuggacaucaucgggcagcggaucgagaacaucaagcacgagcacaaguccaccuggcacuacgacgaggacaaccccuacaagaccugggccuaccacggcagcuacgaggucaagcccuccgggagcgccuccagcauggugaacggcguggucaagcugcucacgaagcccugggacgugaucccgauggucacccagaucgcgaugaccgacaccacgcccuucgggcagcagcgcguguucaaggagaagguggacacccggacccccaaggccaagcgcggcaccgcccagaucauggaggucacggcccgguggcuguggggcuuccugagccgcaacaagaagccgcggaucugcacccgcgaggaguucacccggaaggugcgcuccaacgcggccaucggggccguguucgucgacgagaaccaguggaacagcgccaaggaggccguggaggacgaccgguucugggaccucgugcaccgcgagcgggagcugcacaagcagggcaagugcccgaccugcgucuacaacaugauggggaagcgcgagaagaagcugggcgaguucgggaaggcgaagggcucccggcccaucugguacauguggcucggcgcccgcuuccuggaguucgaggcccugggguucaugaacgaggaccacugguucagccgggagaacucccucagcggcguggagggggaggcccugcacaagcugggcuacauccuccgcgacaucuccaagauccccgggggcaacauguacgccgacgacacggcgggcugggacacccggaucaccgaggacgaccugcagaacgaggggaagaucaccgacaucauggagccggagcacgcccugcucgccaagagcaucuucaagcugacguaccagaacaaggugguccgcgugcagcggcccgccaagaacggcaccgugauggacgucaucucccgccgcgaccagcgggggagcggccaggugggcaccuacgggcugaacaccuucacgaacauggaggcccagcucauccgccagauggaguccgagggcaucuuccugcccaacgagcuggagacccccaaccucgcggggcgggugcuggacuggcuggagaaguacggcgucgagcgccucaagcggauggccaucagcggggacgacugcguggugaagccgaucgacgaccgcuucgccaccgcccugaccgcccugaacgacaugggcaagguccggaaggacaucccccagugggagcccuccaagggcuggaacgacuggcagcagguccccuucugcagccaccacuuccaccagcucaucaugaaggacgggcgcgagaucguggucccgugccggaaccaggacgagcuggugggccgcgcgcgggugucccagggggccggcuggacgcugcgcgagaccgccugccucggcaagagcuacgcccagauguggcagcugauguacuucccccggcgcgcgcugcggcucgccgccaacgccaucugcuccgccguccccguggacugggugcccaccagccgcaccacguggagcauccacgcgcaccaccaguggaugaccaccgaggacaugcuguccgucuggaaccggguguggaucgaggagaacccguggauggaggacaagacccgcaucagcuccugggaggacgugcccuaccugggcaagcgggaggaccaguggugcggcagccucaucgggcugacgccccgcgccaccuggcccaccaacauccaggucgccaucaaccaggugcgccggcugaucggcaacgagaacuacuccgacuacaugaccagcaugaagcgcuucaagaacgaguccgagccggagggggcccucugguga

SEQ ID NO: 8603 - RNA, 9879 nt, Artificial Sequence
  derived and/or modified CDS sequence (opt1) from DENV-1__GU131679__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcggcgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgggagcugaagugcgggagcggcaucuucgugacgaacgaggugcacaccuggaccgagcaguacaaguuccaggccgacagcccgaagcgccucuccgccgccaucggcaaggccugggaggagggggucugcggcauccggagcgcgacccgccuggagaacaucauguggaagcagaucuccaacgagcugaaccacauccuccuggagaacgacaugaaguucaccgugguggucggggacguggccggcauccuggcccaggggaagaagaugauccggccccagcccauggaguacaaguacagcuggaaguccuggggcaaggccaagaucaucggcgcggacgugcagaacgccacguucaucaucgacgggcccaacaccccggagugccccgacgaccagcgcgccuggaacaucugggaggucgaggacuacggcuucgggaucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagaccuggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucgaccucugcgagggcaccaccguggucguggacgagcacugcggcaaccgggggccgucccugcgcacgaccaccgugaccggcaagaucauccacgaguggugcugccggagcugcacgcugccgccccugcgcuucaagggggaggacggcugcugguacgggauggagauccggcccgucaaggagaaggaggagaaccuggugaaguccauggugagcgcgggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucaccuggaacgaccugauccggcugugcaucauggucggcgccaacgccagcgaccgcauggggaugggcacgacguaccucgcccugauggcgaccuucaagaugcgcccgauguucgccguggggcuccuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggcgacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggacgaugaagaucaaggacgaggagcgggacgacaugcugaccauccugcucaaggccacccugcuggccguguccggcguguacccgcucagcauccccgcgacccuguucgucugguacuucuggcagaagaagaagcagcgcuccggggugcugugggacacccccuccccgcccgagguggagcgggccguccucgacgacggcaucuaccgcaucaugcagcggggccugcuggggcgcucccaggugggcgugggggucuuccaggagaacguguuccacacgauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcgcccgggacguucaagaccagcgagggcgaggucggcgccaucgcccucgacuucaagcccgggaccuccggcagccccaucgugaaccgcgaggggaagaucgugggccuguacggcaacggggucgugaccacgagcggcaccuacguguccgccaucgcgcaggccaaggccagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacgcugauccuggcgccgacccgcguggucgccagcgagauggccgaggcccucaagggcaugcccauccgcuaccagaccaccgccgugaaguccgagcacacgggcaaggagaucguggaccugaugugccacgcgaccuucaccaugcggcugcucagccccguccgcgugcccaacuacaacaugaucaucauggacgaggcccacuucaccgacccguccagcaucgccgcccggggguacaucuccacgcgcgugggcaugggggaggccgcggccaucuucaugaccgccacgccgcccggcagcgucgaggccuucccccaguccaacgcggugauccaggacgaggagcgggacaucccggagcgcagcuggaacuccggguacgaguggaucaccgacuuccccggcaagacggugugguucguccccagcaucaaguccggcaacgacaucgccaacugccugcggaagaacgggaagcgcgugauccagcugagccggaagaccuucgacaccgaguaccagaagaccaagaacaacgacugggacuacguggucacgaccgacaucuccgagaugggcgccaacuuccgcgccgaccgggugaucgacccccgccggugccucaagccggugauccugaaggacgggcccgagcgcgucauccuggccggccccaugcccgugaccgucgcgagcgccgcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgccgccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcgcgcaccuacagcgacccccuggcccuccgggaguucaaggaguucgccgccggccgccgguccgucagcggggaccugauccuggagaucggcaagcucccccagcaccugacgcagcgcgcgcagaacgcccuggacaaccucgugaugcugcacaacuccgagcagggcgggcgggccuaccgccacgccauggaggagcugccggacaccaucgagacccucaugcugcuggcccucaucgcggugcugaccggcggggucacgcuguucuuccucagcggccgggggcugggcaagaccuccaucggccugcucugcgugauggccagcuccgugcugcuguggauggccagcgucgagccccacuggaucgccgccuccaucauccucgaguucuuccugauggugcugcucauccccgagcccgaccgccagcggaccccgcaggacaaccagcuggcguacguggucaucgggcuccucuucaugauccugaccguggccgccaacgagaugggccugcucgagaccacgaagaaggaccuggggaucggccacguggccgucgagaaccaccaccacgccgcgaugcuggacguggaccuccaccccgccagcgccuggacccuguacgccguggccaccaccaucaucacgcccaugaugcgccacaccaucgagaacaccaccgcgaacaucucccugacggccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacccgggaggcccagaagcgcacggccgcgggcaucaugaagaacccgaccguggacgggaucguggccaucgagcuggaccccgucguguacgacaccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccaccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccaggucgccaucaaccaggugcgccgccugaucggcaacgagaacuaccuggacuacaugaccagcaugaagcgguucaagaacgagaucgacccggagggggcccucugguga

SEQ ID NO: 8604 - RNA, 9879 nt, Artificial Sequence
  derived and/or modified CDS sequence (opt1) from DENV-1__GU131680__SS-prME
agcgugaccaugcugcugaugcugaugcccaccgcccuggccuuccaccucaccacccggggcggggagccccacaugguggugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccucgcgccccacgucggccuggggcuggagacgcggaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcggugcugcggaagcucugcaucgaggccaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccuccugacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcuggugcacaagcagugguuccuggaccucccccugcccuggaccagcggggccagcaccucccaggagacguggaaccggcaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggccgacuccgggugcgugaucaacuggaagggccgggagcugaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccguggucgugggggacguggcgggcauccugguccaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacgcaggucugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcaucuggcccaagagccacacccucugguccaacggcguccuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgugguggucgacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgugaaggagaaggaggagaaccucgucaagagcauggugagcgccggcuccggcgagguggacagcuucucccuggggcugcucugcaucagcaucaugaucgaggaggucaugcggucccgcuggagccggaagaugcugaugaccggcacccuggccguguucuuccuccugaucauggggcagcugaccuggaacgaccucauccgccugugcaucauggugggcgccaacgcguccgaccgcauggggaugggcacgaccuaccuggcccucauggccaccuucaagaugcggccgauguucgccgucggccugcuguuccgccggcucaccagccgcgaggugcugcugcucacgaucgggcugucccuggucgccagcguggagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgucagccuguucccccugugccucuccaccacgagccagaagaccaccuggcugcccgugcugcucggcucccuggggugcaagccgcugaccauguuccucaucgcggagaacaagaucuggggccggaaguccuggccccugaacgaggggaucauggccgugggcaucgucagcauccugcucuccagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggacgaugaagaucaaggacgaggagcgcgacgacacccucaccauccugcugaaggcgacccuccuggccgucagcggcguguacccgcuguccauccccgccacccucuucguguggcacuucuggcagaagaagaagcagcggagcgggguccugugggacacgcccagcccgcccgagguggagcgcgccgugcuggacgacggcaucuaccggaucaugcagcgcggccugcucgggcggagccaggucggcguggggguguuccaggagaacgucuuccacaccauguggcacgugacccgcggcgccgugcugauguaccaggggaagcggcuggagcccuccugggcgagcgucaagaaggaccucaucuccuacggcggcggguggcgcuuccagggcagcuggaacaccggggaggagguccaggugaucgccgucgagcccggcaagaaccccaagaacgugcagacggcccccgggaccuucaagacccccgagggcgaggugggcgccaucgcccuggacuucaagcccgggaccuccggcagccccaucgucaaccgggaggggaagaucgugggccuguacggcaacgggguggucacgaccagcggcaccuacguguccgcgaucgcccaggccaaggccagccaggaggggccgcuccccgagaucgaggacgagguguuccgcaagcggaaccugaccaucauggaccugcaccccggcuccgggaagacgcgccgguaccucccggcgaucguccgcgaggccaucaagcggaagcugcgcacccugauccucgcccccacccgcgugguggccagcgagauggccgaggcgcugaagggcaugcccauccgguaccagaccacggccgucaaguccgagcacaccggcaaggagaucguggaccugaugugccacgccaccuucaccaugcgccuccugagccccgugcgggucccgaacuacaacaugaucaucauggacgaggcccacuucacggaccccuccagcaucgccgcgcgcggguacaucuccacccgggugggcaugggggaggccgccgccaucuucaugaccgccacgccgcccggcagcauggaggcguucccgcaguccaacgccgugauccaggacgaggagcgcgacauccccgagcggagcuggaacuccggguacgaguggaucacggacuuccccggcaagaccgucugguucgugcccagcaucaaggccggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgcgaacuuccgggccgaccgcgugaucgacccgcggcgcugccugaagcccgucauccugaaggacgggcccgagcgggugauccucgccggccccaugccggucaccguggccuccgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccgucuggcuguccuacaagguggccagcgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccccucgcccugcgcgaguucaaggaguucgcggccggccggcgcagcguguccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccguccugacgggcggggugacccucuucuuccuguccggcaaggggcugggcaagaccagcaucggccuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagacgaccaagaaggaccuggggaucggccacgucgccguggagaaccaccaccacgccgccaugcucgacguggaccugcaccccgccuccgcguggacccuguacgccgucgccaccacgaucaucaccccgaugaugcgccacaccaucgagaacaccacggccaacaucagccucaccgccaucgcgaaccaggccgccauccugauggggcuggacaagggcuggcccaucuccaagauggacaucggcgugccccuccuggcccuggggugcuacagccaggugaacccccucacccugaccgcggccguccugaugcucguggcccacuacgccaucaucggcccggggcugcaggccaaggcgacgcgggaggcccagaagcgcaccgccgccggcaucaugaagaaccccaccaucgacgggaucguggccaucgaccuggaccccgucguguacgacgcgaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggccaacaucuuccggggguccuaccuggcgggcgccggccuggccuucagccucaugaagucccucgggggcgggcgccgggggacgggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagaccacgaagcacgccgugucccgcggcaccgccaagcuccggugguucguggagcgcaaccuggucaagcccgaggggaaggugaucgaccugggcugcggccgcgggggcuggagcuacuacugcgccgggcugaagaaggugaccgaggucaagggcuacaccaagggcggccccggccacgaggagcccaucccgauggccacguacggguggaaccucgugaagcugcacuccggcaaggacguguucuucaucccgcccgagaagugcgacacccugcucugcgacaucggggagagcucccccaacccgaccaucgaggagggccgcacccugcggguccugaagaugguggagcccuggcuccgcgggaaccaguucugcaucaagauccugaaccccuacaugcccagcguggucgagacgcuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgguucaccauggcccaccgcaagcccacguacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagccgagcggcuccgccagcagcauggugaacggggucgugaagcuccugacgaagcccugggacgugauccccauggucacccagaucgccaugaccgacaccacgcccuucggccagcagcggguguucaaggagaagguggacacccgcaccccgaaggccaagcgggggaccgcccagaucauggaggucacggcgcgcuggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgaccgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagccggagcacgcgcuccuggccaaguccaucuucaagcugacguaccagaacaaggugguccgggugcagcgccccgccaagaacgggaccgugauggacgucaucagccgccgggaccagcgcggcuccggccagguggggaccuacggccucaacaccuucacgaacauggaggcccagcugauccggcagauggagagcgaggggaucuuccugcccaacgagcucgagacccccaaccuggccggccgcgugcuggacuggcucgagaaguacggggucgagcggcugaagcgcauggcgaucuccggcgacgacugcguggugaagccgaucgacgaccgguucgccaccgcccugaccgcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgcgggguggucccuccgggagacggccugccugggcaagagcuacgcccagauguggcagcugauguacuuccaccgccgggaccuccgccuggccgcgaacgccaucugcagcgccguccccguggacugggugcccaccucccggaccaccuggagcauccacgcccaccaccaguggaugacgaccgaggacaugcuguccgucuggaaccgcguguggaucgaggagaaccccuggauggaggacaagacccggaucagcuccugggaggacgugccguaccucgggaagcgcgaggaccaguggugcggcagccugaucggccugaccgcccgcgcgacgugggccaccaacauccaggucgccaucaaccaggugcggcgccucaucgggaacgagaacuacuccgacuacaugaccagcaugaagcgguucaagaacgaguccgagcccgagggcgcccugugguga

SEQ ID NO: 8605 - RNA, 9879 nt, Artificial Sequence
  derived and/or modified CDS sequence (opt1) from DENV-1__GU131681__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaaggugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacccugcuggccgucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucguccgggaggccaucaagcgcaagcuccggacccugauccuggcccccacccgcgugguggccuccgagauggccgaggcgcucaagggcaugcccauccgcuaccagacgaccgccgucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgccaacuuccgcgcggaccgggucaucgacccgcgccggugccucaagcccgugauccugaaggacgggcccgagcgcgucauccuggccggccccaugccggugacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacaccaucgagacgcucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggcgguggagaaccaccaccacgccaccaugcuggacgucgaccuccaccccgccuccgccuggacgcuguacgccguggcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggucaacccccugacgcucaccgccgccgugcugaugcugguggcgcacuacgccaucaucggcccggggcuccaggccaaggccacccgggaggcccagaagcgcaccgcggccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacacgaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugacgucccggaugcugcugaaccgcuucaccauggcccaccgcaagcccaccuacgagcgggacguggaccucggggcgggcacccgccacguggccgucgagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcucaccaagcccugggacgugauccccauggugacccagaucgcgaugacggacaccacccccuucggccagcagcgcgucuucaaggagaagguggacacccggacgccgaaggccaagcgcgggaccgcccagaucauggaggugaccgcccgguggcuguggggcuuccugucccgcaacaagaagccccggaucugcacccgcgaggaguucacgcggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaagguggugcggguccagcgccccgcgaagaacgggacggugauggacgugaucagccgccgggaccagcgcggcuccgggcaggucggcaccuacggccugaacaccuucaccaacaugggggcccagcucauccggcagauggagagcgagggcaucuucucccccagcgagcuggagauccccaaccuggccgagcgcgugcucgacuggcuggagaaguacgggguggagcggcugaagcgcauggccaucuccggcgacgacugcgucgugaagccgaucgacgaccgguucgccacggcgcucaccgcccugaacgacauggggaaggugcgcaaggacgucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgccggguggagccugcgggagaccgccugccugggcaaguccuacgcgcagauguggcagcucauguacuuccaccgccgggaccugcgccuggccgccaacgccaucugcagcgcgguccccguggacugggugcccaccucccggacgaccuggagcauccacgcccaccaccaguggaugaccaccgaggacaugcucuccgucuggaaccgcguguggaucgaggagaaccccuggauggaggacaagacgcacgugagcuccuggggcgacgucccguaccugggcaagcgggaggaccaguggugcggcagccugaucgggcucaccgcccgcgccaccugggccuccaacauccagguggcgaucaaccaggugcgccggcugaucggcaacgagaacuaccuggacuacaugaccagcaugaagcgcuucaagaacgagggggaccccgagggcgcccucugguga

SEQ ID NO: 8606 - RNA, 9879 nt, Artificial Sequence
  derived and/or modified CDS sequence (opt1) from DENV-1__GU131682__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucaucaucggcgccggcgagaaggcccugaagcucagcugguucaagaagggguccagcaucggcaagauguucgaggcgacggcccgcggggcccggcgcauggccauccugggcgacaccgccugggacuucggguccaucggcggcguguucaccagcgucgggaagcuggugcaccagaucuucggcaccgcguacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcccaggggaagaagaugauccggccccagcccauggagcacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgccagcgaccgcauggggaugggcaccaccuaccuggcgcugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggccaugggcaucaugauccucaagcugcugaccgacuuccagucccaccagcucugggcgacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgccgagaacaagaucuggggccggcgcuccuggccccucaacgaggggaucauggcggucggcaucgugagcauccugcugagcucccuccugaagaacgacgugccccuggccgggccccucaucgccggcggcaugcugaucgccugcuacgucaucagcggguccagcgccgaccugucccucgagaaggcggccgaggugagcugggaggaggaggccgagcacuccggcgccagccacaacauccugguggagguccaggacgacgggaccaugaagaucaaggacgaggagcgggacgacacccugaccauccuccugaaggccacgcugcucgcgguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggccuccgugaagaaggaccugaucagcuacggcggcggguggcggcuccagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgccaucgcgcaggccaaggccucccaggaggggccgcuccccgagaucgaggacgaggucuuccggaagcgcaaccugaccaucauggaccugcaccccggcagcgggaagacccggcgcuaccucccggccaucgugcgggaggcgaucaagcgcaagcugcgcacccugauccucgcccccacgcggguggucgccuccgagauggccgaggcccugaagggcaugcccauccgcuaccagaccaccgcggucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcccggggguacaucagcacccgcgugggcaugggggaggcggccgccaucuucaugacggccacgccgcccggcuccgucgaggccuucccgcagagcaacgcggugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgccgaccgggugaucgacccgcgccggugccugaagcccgugauccugaaggacgggcccgagcgcgucauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgcgagaaguccgccgccaucgacggggaguaccggcugcgcggcgaggcccggaagacguucguggagcucaugcgccgcggggaccugcccguguggcuguccuacaaggucgcgagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgccggccgccggagcgucuccggggaccugauccucgagaucggcaagcugccgcagcaccugacccagcgcgcgcagaacgcccucgacaaccuggugaugcugcacaacagcgagcagggcgggcgggccuaccgccacgccauggaggagcuccccgacacgaucgagacccugaugcugcucgcgcugaucgccgugcugaccggcggggucacccucuucuuccuguccggccgggggcugggcaagaccagcaucggccuccugugcgugauggccuccagcgugcugcucuggauggccuccgucgagccccacuggaucgccgcgagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggccgucgagaaccaccaccacgcggccaugcucgacguggaccugcaccccgccuccgccuggacgcuguacgccguggcgaccaccaucaucaccccgaugaugcgccacacgaucgagaacaccaccgccaacaucagccucaccgccaucgccaaccaggccgcgauccugauggggcuggacaagggcuggcccaucuccaagauggacaucggcgucccccuccuggcccuggggugcuacagccaggugaacccccucacgcugaccgccgccgugcugaugcucgucgcgcacuacgccaucaucggcccggggcugcaggccaaggccacccgcgaggcccagaagcggaccgcggccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcccucugcgagagcaucacgcuggcgaccggcccccugaccacccucugggagggguccccgggcaaguucuggaacacgaccaucgccgugagcauggccaacaucuuccggggguccuaccuggccggcgccggccuggcguucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgccgugucccgcggcaccgcgaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcccaccggaagcccaccuacgagcgcgacguggaccugggggcgggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcuccugaccaagcccugggacgugauccccauggucacccagaucgcgaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgcggacgacaccgccggcugggacacccggaucacggaggacgaccugcagaacgaggcccgcaucaccgacaucauggagccggagcacgcccuccuggccaaguccaucuucaagcugaccuaccagaacaaggugguccgcgugcagcggcccgcgaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggccaucuccggggacgacugcguggugaagccgaucgacgaccgguucgccacggcgcugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgccugccucgggaaguccuacgcgcagauguggcagcugauguacuuccaccgccgggaccugcgccucgccgccaacgccaucugcagcgcgguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgcgaggaccaguggugcggcagccucaucggccugaccgcccgggccaccugggccaccaacauccagguggcgaucaaccagguccgccggcugaucgggaacgagaacuaccucgacuacaugaccuccaugaagcgcuucaagaacgagagcgaccccgagggcgcccugugguga

SEQ ID NO: 8607 - RNA, 9879 nt, Artificial Sequence
  derived and/or modified CDS sequence (opt1) from DENV-1__GU131683__SS-prME
agcgugaccaugcugcugaugcugaugcccaccgcccuggccuuccaccucaccacccggggcggggagccccacaugaucgugagcaagcaggagcggggcaagagccugcuguucaagacccccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcggagcguggcccucgccccgcacgugggccuggggcuggagacccgcaccgagaccuggaugagcagcgagggcgcguggaagcagauccagcgggucgagacgugggcccuccggcaccccggguucaccgugaucgcccuguuccuggcccacgcgaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaacccggccgugcugcggaagcucugcaucgaggcgaagaucagcaacaccacgaccgacucccgcugccccacccagggcgaggccacccugguggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccaccgagauccagcucaccgacuacggggcccugacgcuggacugcuccccgcgcaccggccucgacuucaacgagaugguccugcugaccaugaaggagaaguccuggcucgcccacaagcagugguuccuggaccugccccuccccuggaccuccggggccagcacgagccaggagaccuggaaccggcaggaccugcuggugaccuucaagaccgcccacgcgaagaagcaggagguggucgugcucggcucccaggagggcgccaugcacacggcccugaccggggccaccgagauccagaccagcggcacgaccaccaucuucgccgggcaccugaagugccgccucaagauggacaagcugacccugaagggcauguccuacgugaugugcacggggagcuucaagcucgagaaggagcuggcggagacccagcacggcaccguccuggugcagaucaaguacgagggcaccgacgcccccugcaagaucccguucuccacgcaggacgagaagggggugacccagaacggccggcugaucaccgccaaccccaucgucaccgacaaggagaagcccgugaacaucgaggccgagcccccguucggggagagcuacaucgugaucggcgcgggcgagaaggcccucaagcuguccugguucaagaaggggagcuccaucggcaagauguucgaggccacggcccgcggggcccggcgcauggcgauccugggcgacaccgccugggacuucgggagcaucggcggcgucuucaccuccgccgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggcggacagcgggugcgucaucaacuggaagggccgggagcugaagugcggguccggcaucuucgugaccaacgaggugcacaccuggaccgagcaguacaaguuccaggccgacagccccaagcgccugagcgccgccaucggcaaggccugggaggagggggucugcggcauccgguccgcgacccgccucgagaacaucauguggaagcagaucagcaacgagcugaaccacauccugcucgagaacgacaugaaguucacggugguggucggggacguggccggcauccuggcccaggggaagaagaugauccggccccagcccauggaguacaaguacuccuggaaguccuggggcaaggccaagaucaucggcgcggacgugcagaacaccaccuucaucaucgacgggccgaacacccccgagugccccgacgaccagcgcgccuggaacaucugggaggucgaggacuacggcuucgggaucuucacgaccaacaucuggcugaagcuccgggacuccuacacccaggugugcgaccaccgccugaugagcgccgccaucaaggacuccaaggccgugcacgcggacaugggcuacuggaucgagagcgagaagaacgagaccuggaagcuggcccgggccuucuucaucgaggucaagacgugcaucuggcccaagucccacacccucuggagcaacggcgugcuggaguccgagaugaucaucccgaagaucuacgggggccccaucagccagcacaacuaccgccccggguacuucacccagaccgccggcccguggcaccuggggaagcucgagcuggacuucgaccugugcgagggcacgaccguggucguggacgagcacugcggcaaccgggggcccucccuccgcaccaccacggugaccggcaagaucauccacgaguggugcugccggagcugcacccugccgccccugcgcuuccgcggggaggacggcugcugguacgggauggagauccgcccggucaaggagaaggaggagaaccucgugaaguccauggugagcgccggcuccggcgaggucgacagcuucagccuggggcugcucugcaucuccaucaugaucgaggaggugaugcggagccgcuggucccggaagaugcugaugaccggcacgcuggcgguguucuuccuccugaucauggggcagcugaccuggaacgaccucauccgccugugcaucauggucggcgccaacgccagcgaccgcauggggaugggcaccaccuaccuggcccucauggccacguucaagaugcggcccauguucgcggugggccugcuguuccgccggcucaccucccgcgaggugcugcugcucaccaucgggcugagccuggucgccuccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgcguggaagacgauggccauggugcucagcaucgucucccuguucccccugugccucagcaccaccucccagaagaccacguggcugccggugcugcucggcagccuggggugcaagccccugaccauguuccucaucgccgagaacaagaucuggggccggcgcuccuggccccugaacgaggggaucauggccgucggcaucgugagcauccugcucuccagccugcugaagaacgacgugccccucgccgggccgcugaucgcgggcggcaugcugaucgccugcuacgucaucagcggguccagcgccgaccucucccuggagaaggccgccgaggugagcugggaggaggaggcggagcacuccggcgccagccacaacauccugguggagguccaggacgacgggaccaugaagaucaaggacgaggagcgggacgacacccucaccauccugcugaaggccacgcuccuggccguguccggcguguacccccugagcauccccgccacccucuucgucugguacuucuggcagaagaagaagcagcgcuccggggugcugugggacacccccagcccgcccgagguggagcgggcgguccuggacgacggcaucuaccgcaucaugcagcggggccugcucgggcgcucccaggugggcgugggggucuuccaggagaacguguuccacaccauguggcacgugacgcggggcgccguccugauguaccaggggaagcgccuggagcccagcugggccuccgugaagaaggaccucaucagcuacggcggcggguggcggcugcagggcuccuggaacaccggggaggaggugcaggucaucgccguggagcccggcaagaacccgaagaacgugcagaccgcccccgggaccuucaagacgcccgagggcgaggucggcgcgaucgcccuggacuucaagcccgggaccagcggcuccccgaucgugaaccgcgaggggaagaucgugggccucuacggcaacggggucgugaccaccagcggcacguacguguccgccaucgcccaggcgaaggccagccaggaggggccccugcccgagaucgaggacgaggucuuccggaagcgcaaccugaccaucauggaccuccacccgggcagcgggaagacccggcgcuaccugcccgccaucgugcgggaggccaucaagcgcaagcugcgcacccucauccuggcccccacgcggguggucgcguccgagauggccgaggcccugaagggcaugcccauccgcuaccagaccaccgccgucaagagcgagcacaccggcaaggagaucguggaccucaugugccacgccacguucaccaugcggcugcuguccccgguccgcgugcccaacuacaacaugaucaucauggacgaggcgcacuucaccgaccccagcuccaucgccgcccggggguacaucagcacccgcgugggcaugggggaggccgccgcgaucuucaugacggccacgcccccgggcuccgucgaggccuucccccagagcaacgccgugauccaggacgaggagcgggacauccccgagcgcuccuggaacagcggguacgaguggaucaccgacuuccccggcaagaccgugugguucgucccguccaucaagagcggcaacgacaucgcgaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccucaaggacgggcccgagcgcgucauccuggccggcccgaugcccgugaccguggccuccgcggcccagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucaucccggcccuguucgagcccgagcgcgagaaguccgcggccaucgacggggaguaccggcuccgcggcgaggcccggaagacguucgucgagcugaugcgccgcggggaccugcccguguggcucuccuacaaggucgccagcgagggcuuccaguacuccgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccgcuggcgcugcgggaguucaaggaguucgccgccggccgccggagcgucuccggggaccucauccuggagaucggcaagcugccccagcaccucacccagcgcgcccagaacgcgcuggacaaccuggugaugcuccacaacagcgagcagggcgggcgggccuaccgccacgccauggaggagcugcccgacacgaucgagacccugaugcuccuggcccugaucgccgugcucaccggcggggucacccuguucuuccuguccggccgggggcucggcaagaccagcaucggccugcugugcgugauggcguccagcgugcuccuguggauggccuccgucgagccccacuggaucgccgccagcaucauccuggaguucuuccucauggugcugcugaucccggagcccgaccgccagcggacgccccaggacaaccagcucgccuacguggucaucgggcugcuguucaugauccucaccguggcggccaacgagaugggccugcuggagaccaccaagaaggaccucgggaucggccacguggccgucgagaaccaccaccacgccgccaugcuggacguggaccugcacccggcguccgccuggacgcucuacgccguggccaccaccaucaucacccccaugaugcgccacacgaucgagaacaccaccgccaacaucagccugaccgcgaucgccaaccaggccgccauccugauggggcucgacaagggcuggcccaucuccaagauggacaucggcgucccccugcuggcgcucgggugcuacagccaggugaacccgcugacgcugaccgccgccgugcucaugcuggucgcccacuacgccaucaucggccccgggcugcaggcgaaggccacccgcgaggcccagaagcggaccgccgccggcaucaugaagaaccccacgguggacgggaucguggcgaucgaccucgaccccgucguguacgacgccaaguucgagaagcagcugggccagaucaugcugcucauccugugcaccucccagauccugcucaugcgcaccaccugggcccugugcgagagcaucacgcuggccaccggcccgcucaccacccugugggaggggucccccggcaaguucuggaacacgaccaucgccgugagcauggcgaacaucuuccggggguccuaccuggccggcgccggccucgccuucagccugaugaagucccucgggggcgggcgccgggggaccggggcgcagggcgagacccucggcgagaaguggaagcgccagcugaaccagcugagcaagagcgaguucaacacguacaagcgguccgggaucauggaggucgaccgcagcgaggccaaggagggccucaagcgcggggagaccaccaagcacgccgugucccgcggcaccgccaagcugcggugguucguggagcgcaaccuggucaagcccgaggggaaggugaucgaccugggcugcggccgcggcggguggagcuacuacugcgccgggcucaagaaggugacggaggucaagggguacaccaagggcggccccggccacgaggagccgauccccauggcgaccuacggguggaaccuggugaagcugcacuccggcaaggacguguucuucaucccgcccgagaagugcgacacccuccugugcgacaucggggagagcuccccgaaccccacgaucgaggagggccgcacccugcggguccucaagaugguggagcccuggcugcgcgggaaccaguucugcaucaagauccugaaccccuacaugccgagcguggucgagacccucgagcagaugcagcggaagcacggcggcaugcuggugcgcaacccccugucccggaacagcacccacgagauguacuggguguccugcgggaccggcaacaucgucagcgccgugaacaugacgucccgcaugcuccugaaccgcuucaccauggcccaccggaagcccaccuacgagcgcgacguggaccugggggccggcacccggcacgucgccguggagcccgagguggcgaaccucgacaucaucggccagcgcaucgagaacaucaagcacgagcacaagagcacguggcacuacgacgaggacaacccguacaagaccugggccuaccacggguccuacgaggucaagcccagcggcuccgccagcuccauggugaacgggguggucaagcugcugaccaagcccugggacgugauccccauggucacccagaucgccaugacggacaccaccccguucggccagcagcggguguucaaggagaagguggacacccgcacgcccaaggccaagcgggggaccgcgcagaucauggaggucaccgccaaguggcucuggggcuuccugagccgcaacaagaagccccggaucugcacccgcgaggaguucacgcggaaggugcgcagcaacgccgccaucggcgcgguguucgucgacgagaaccaguggaacuccgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcgcgcaucaccgacaucauggagcccgagcacgcccugcuggccaaguccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagaccccgaaccuggcggagcgcgugcuggacuggcucgagaaguacggcgucgagcggcugaagcgcauggccaucuccggggacgacugcguggugaagcccaucgacgaccgguucgccacggcccugaccgcccucaacgacaugggcaagguccgcaaggacaucccccagugggagcccagcaagggguggaacgacuggcagcaggucccguucugcucccaccacuuccaccagcugaucaugaaggacggccgggagaucgugguccccugccgcaaccaggacgagcuggugggccgggcgcgcgugagccagggggccggcuggucccuccgggagaccgccugccugggcaagagcuacgcccagauguggcagcugauguacuuccaccgccgggaccuccgccuggcggccaacgccaucugcagcgccguccccguggacuggauccccaccucccggacgaccuggagcauccacgcccaccaccaguggaugaccaccgaggacaugcuguccguguggaaccgcgucuggaucgaggagaacccguggauggaggacaagacgcacaucagcuccuggggcgacgugcccuaccucgggaagcgcgaggaccaguggugcggcagccugaucggccugaccgcgcgggccaccugggccaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8608 - RNA, 9879 nt, Artificial Sequence
  derived and/or modified CDS sequence (opt1) from DENV-1__GU131684__SS-prME
agcgugaccaugcugcugaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcaaggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccguggggcuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgugguguccugggaggaggaggccgagcacagcggcgcgucccacaacauccuggucgaggugcaggacgacgggacgaugaagaucaaggacgaggagcgcgacgacacccugaccauccuccugaaggccacccugcucgccgugagcggcgucuacccgcuguccauccccgccacccuguucgugugguacuucuggcagaagaagaagcagcggagcggggugcucugggacacgcccagcccgcccgaggucgagcgcgccgugcuggacgacggcaucuaccggaucaugcagcgcggccugcuggggcggagccaggugggcgucgggguguuccaggagaacguguuccacaccauguggcacgucacccgcggcgcggugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgggaggggaagaucgucggccuguacggcaacgggguggugacgaccuccggcaccuacgucagcgccaucgcccaggccaaggcgucccaggaggggccccucccggagaucgaggacgagguguuccgcaagcggaaccugaccaucauggaccugcaccccggcagcgggaagacgcgccgguaccuccccgccaucgugcgcgaggccaucaagcggaagcugcgcacccugauccucgccccgacccgcgucguggccuccgagauggcggaggcccugaagggcaugcccauccgguaccagaccacggccgucaagagcgagcacaccggcaaggagaucgucgaccugaugugccacgccaccuucaccaugcgccuccugucccccgugcgggugcccaacuacaacaugaucaucauggacgaggcccacuucacggacccgagcuccaucgcggcccgcggguacaucagcacccgggucggcaugggggaggccgccgccaucuucaugaccgcgacgccgcccggcuccguggaggccuucccccagagcaacgccgugauccaggacgaggagcgcgacaucccggagcgguccuggaacagcggguacgaguggaucacggacuuccccggcaagaccgucugguucgugcccuccaucaagagcggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgcgaacuuccgggccgaccgcgugaucgacccccggcgcugccugaagccggucauccugaaggacgggcccgagcgggugauccucgccggccccaugcccgucaccguggccuccgccgcgcagcgccgggggcgcaucggccggaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccgccugcggggcgaggcccgcaagaccuucguggagcucaugcggcgcggggaccugccggucuggcugagcuacaagguggccuccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccccucgcccugcgcgaguucaaggaguucgcggccggccggcgcagcguguccggggaccugauccucgagaucggcaagcugccccagcaccugacccagcgggcccagaacgcccucgacaaccuggugaugcugcacaacagcgagcagggcgggcgcgcguaccggcacgccauggaggagcucccggacaccaucgagacccugaugcugcucgcccugaucgccguccugacgggcggggugacccucuucuuccuguccggccgcgggcugggcaagaccagcaucggccuccugugcgugauggccuccagcguccugcucuggauggcguccguggagccccacuggaucgccgccagcaucauccuggaguucuuccugauggugcuccugauccccgagcccgaccggcagcgcaccccgcaggacaaccagcuggccuacgucgugaucgggcuccuguucaugauccugaccguggccgcgaacgagaugggccuccuggagacgaccaagaaggaccuggggaucggccacgucgccguggagaaccaccaccacgccgccaugcucgacguggaccugcaccccgccuccgcguggacccuguacgccgucgccaccacgaucaucacccccaugaugcggcacaccaucgagaacaccacggccaacaucagccucaccgccaucgcgaaccaggccgccauccugauggggcuggacaagggcuggccgaucuccaagauggacaucggcgugccccuccuggcccuggggugcuacagccaggugaacccccucacccugaccgcggccguccugaugcucguggcccacuacgccaucaucggccccgggcugcaggccaaggcgacgcgcgaggcccagaagcgcaccgccgccggcaucaugaagaacccgaccguggacgggaucgucgccaucgaccuggaccccgugguguacgacgcgaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgucagcauggccaacaucuuccgcgggagcuaccuggcgggcgccggccuggccuucucccucaugaagucccucgggggcgggcggcgcgggacgggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagaccacgaagcacgccgugucccggggcaccgccaagcuccgcugguucgucgagcggaaccuggugaagccggaggggaaggugaucgaccugggcugcggccgcgggggcuggagcuacuacugcgccgggcugaagaaggucaccgaggugaagggcuacaccaagggcgggcccggccacgaggagcccauccccauggccacguacggguggaaccucgugaagcugcacuccggcaaggacgucuucuucaucccgcccgagaagugcgacacccugcucugcgacaucggggagagcucccccaaccccaccaucgaggagggccggacccugcgcgugcugaagaugguggagccguggcuccgggggaaccaguucugcaucaagauccugaaccccuacaugcccagcgucguggagacgcuggagcagaugcagcgcaagcacggcggcaugcucgugcggaacccccugucccgcaacagcacccacgagauguacugggucuccugcgggaccggcaacaucgugagcgcggugaacaugaccucccggaugcugcucaaccgcuucaccauggcccaccgcaagccgacguacgagcgggacgucgaccugggggccggcacccgccacguggccguggagcccgaggucgccaaccuggacaucaucggccagcggaucgagaacaucaagcacgagcacaagagcaccuggcacuacgacgaggacaaccccuacaagaccugggcguaccacggguccuacgaggugaagcccagcggcagcgccuccagcauggucaacgggguggugaagcuccugacgaagccgugggacgucauccccauggugacccagaucgccaugaccgacaccacgcccuucggccagcagcgcguguucaaggagaaggucgacacccggacccccaaggccaagcgcgggaccgcccagaucauggaggugacggcgaaguggcuguggggcuuccucucccggaacaagaagccgcgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagcccgagcacgcgcuccuggccaaguccaucuucaagcugacguaccagaacaaggucgugcgggugcagcgcccggccaagaacgggaccgucauggacgugaucagccgccgggaccagcgcggcuccggccaggugggcaccuacggccucaacaccuucacgaacauggaggcccagcugauccggcagauggagagcgaggggaucuucucccccagcgagcuggagacccccaaccucgccggccgcguccuggacuggcuggagaagcacgggguggagcggcucaagcgcauggcgaucuccggcgacgacugcguggucaagcccaucgacgaccgguucgccaccgcccugaccgcccugaacgacauggggaaggugcgcaaggacaucccgcagugggagcccagcaagggcuggaacgacuggcagcagguccccuucugcagccaccacuuccaccagcucaucaugaaggacggccgggagaucgucgugcccugccgcaaccaggacgagcugguggggcgggcccgcgucucccagggcgcgggguggagccugcgggagacggccugccucggcaaguccuacgcccagauguggcagcugauguacuuccaccgccgggaccugcgccucgccgcgaacgccaucugcagcgccgugccgguggacuggguccccaccucccggaccaccuggagcauccacgcccaccaccaguggaugacgaccgaggacaugcuguccguguggaaccgcguguggaucgaggagaaccccuggauggaggacaagacccacaucagcuccuggggcgacguccccuaccugggcaagcgggaggaccaguggugcggcagccucaucgggcugaccgcccgcgcgacgugggccaccaacauccagguggccaucaaccaggugcgccggcugcucggcaacgagaacuaccuggacuacaugaccuccaugaagcgcuucaagaacgagagcgacccggagggggcccugugguga

SEQ ID NO: 8609 - RNA, 9879 nt, Artificial Sequence
  derived and/or modified CDS sequence (opt1) from DENV-1__GU131685__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggagaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcugauccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgggaugaaguucacggucguggugggcgacgucgccgggauccucgcgcagggcaagaagaugauccggccccagcccauggaguacaaguacagcuggaaguccuggggcaaggccaagaucaucggggccgacgugcagaacaccaccuucaucaucgacggccccaacaccccggagugccccgacgaccagcgcgccuggaacaucugggagguggaggacuacggguucggcaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccgugguggucgacgagcacugcgggaaccggggcccgucccugcgcaccaccacggugaccgggaagaucauccacgaguggugcugccggagcugcacccugccgccccuccgcuuccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacgcuggccguguucuuccugcucaucaugggccagcugaccuggaacgaccugauccgccucugcaucauggugggggccaacgcgagcgaccgcaugggcaugggcaccaccuaccuggcccugauggccacguucaagaugcggccgauguucgccgucgggcuccuguuccgccggcugaccucccgcgaggugcuccugcugaccaucgggcucagccugguggccuccgucgagcugcccaacagccucgaggagcugggggacggccuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcuggggagccucggcugcaagccgcugaccauguuccugaucgcggagaacaagaucugggggcggcgcuccuggccccucaacgagggcaucauggccguggggaucgucagcauccugcugagcucccuccugaagaacgacgugccccuggccggcccccucaucgccggcgggaugcugaucgccugcuacgugaucagcggcuccagcgcggaccugucccucgagaaggccgccgaggucagcugggaggaggaggccgagcacuccggggccagccacaacauccugguggaggugcaggacgacggcaccaugaagaucaaggacgaggagcgggacgacacccugaccauccuccugaaggcgacgcugcucgccgucuccgggguguacccgcugagcauccccgccacccuguucgugugguacuucuggcagaagaagaagcagcgcuccggcguccucugggacacccccagcccgcccgagguggagcgggccgugcuggacgacggcaucuaccgcaucaugcagcgggggcugcugggccgcucccaggucggggugggcguguuccaggagaacgucuuccacaccauguggcacgugacgcgcggggccgugcucauguaccagggcaagcgccuggagcccagcugggcguccgucaagaaggaccugaucagcuacggcgggggcuggcggcuccagggguccuggaacaccggcgaggagguccaggugaucgccgucgagcccgggaagaaccccaagaacgugcagaccgcccccggcaccuucaagacgcccgagggcgaggugggggccaucgcccuggacuucaagcccggcaccagcgggucccccaucgucaaccgcgagggcaagaucgugggccuguacgggaacggcguggucaccaccagcgggacguacgugagcgcgaucgcccaggccaaggccucccaggagggcccgcuccccgagaucgaggacgagguguuccggaagcgcaaccugaccaucauggaccugcaccccgggagcggcaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccgggaaggagaucguggaccugaugugccacgccacguucaccaugcggcuccugucccccgugcgcgucccgaacuacaacaugaucaucauggacgaggcccacuucaccgaccccagcuccaucgccgcgcggggcuacaucagcacccgcguggggaugggcgaggccgccgccaucuucaugacggccacgccgcccggguccguggaggcguucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcucucccggaagacguucgacaccgaguaccagaagaccaagaacaacgacugggacuacguggugaccacggacaucagcgagaugggggccaacuuccgcgcggaccgggucaucgacccgcgccggugccugaagcccgugauccugaaggacggccccgagcgcgugauccucgccgggcccaugccggucaccguggccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucgucgagcucaugcgccggggcgaccugcccguguggcuguccuacaagguggccagcgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcguguccggcgaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccgggggcgugacccucuucuuccuguccgggcggggccugggcaagaccagcaucgggcuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucggccuccuguucaugauccugaccgucgccgccaacgagauggggcuccuggagaccaccaagaaggaccugggcaucgggcacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggugccccuccuggcccugggcugcuacagccaggucaacccccucacgcugaccgccgcggugcugaugcucguggcccacuacgccaucaucgggccgggccugcaggccaaggccacccgcgaggcgcagaagcggaccgccgccgggaucaugaagaaccccacggucgacggcaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggagguggaccgcagcgaggccaaggaggggcugaagcggggcgagaccaccaagcacgcggucucccgcgggaccgccaagcuccggugguucguggagcgcaaccuggugaagcccgagggcaaggucaucgaccugggcugcgggcggggcggguggagcuacuacugcgccggccugaagaaggugacggaggugaagggguacaccaagggcggccccgggcacgaggagcccaucccgauggccaccuacggcuggaaccucgucaagcugcacuccgggaaggacguguucuucaucccgcccgagaagugcgacacccugcucugcgacaucggcgagagcucccccaacccgacgaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccggaacagcacccacgagauguacuggguguccugcggcaccgggaacaucgugagcgccgucaacaugacgucccgcaugcugcucaaccgcuucaccauggcgcaccggaagcccaccuacgagcgcgacguggaccugggcgccggcacccggcacguggccgucgagcccgagguggccaaccuggacaucaucgggcagcgcaucgagaacaucaagcacgagcacaagagcacguggcacuacgacgaggacaaccccuacaagaccugggccuaccacggcuccuacgaggugaagccgagcggguccgcgagcagcauggucaacggcguggucaagcuccugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgccaaguggcuguggggcuuccucucccgcaacaagaagccccggaucugcacccgcgaggaguucacgcggaagguccgcagcaacgcggccaucggggccguguucguggacgagaaccaguggaacuccgccaaggaggcggucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagauccccggcggcaacauguacgccgacgacaccgccgggugggacacccggaucacggaggacgaccugcagaacgaggcccgcaucaccgacaucauggagccggagcacgcccuccuggcgcgcuccaucuucaagcugaccuaccagaacaagguggugcggguccagcgccccgccaagaacggcaccgugauggacgugaucagccggcgcgaccagcggggguccggccaggucggcacguacgggcucaacaccuucaccaacauggaggcccagcugauccgccagauggagagcgagggcaucuucucccccagcgagcuggagacccccaaccucgccgagcgggugcuggacuggcuggagaaguacgggguggagcgccucaagcggauggccaucuccggcgacgacugcgucgugaagccgaucgacgaccgcuucgcgacggcccugaccgcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgcgugccucggcaaguccuacgcccagauguggcagcugauguacuuccaccggcgcgaccugcggcucgccgccaacgcgaucugcagcgccgugcccgucgacuggauccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccugggcaagcgggaggaccaguggugcggcagccucaucgggcugaccgcccgcgccaccugggcgaccaacauccagguggccaucaaccaggugcggcgccugaucggcaacgagaacuaccucgacuacaugaccuccaugaagcgguucaagaacgagagcgaccccgagggggcccugugguga

SEQ ID NO: 8610 - RNA, 9879 nt, Artificial Sequence
  derived and/or modified CDS sequence (opt1) from DENV-1__GQ868614__SS-prME
agcgugaccaugcugcucaugcugaugcccaccgcccuggccuuccaccucaccacccggggcggggagccgcacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccgggcccuucaagcucgagaaggaggucgcggagacgcagcacggcaccgugcuggugcagaucaaguacgagggcaccgacgcccccugcaagaucccguucuccacccaggacgagaagggggucauccagaacggccggcugaucacggccaaccccaucgugaccgacaaggagaagcccgugaacaucgaggccgagcccccguucggggagagcuacaucgucaucggcgugggcgagaaggcgcugaagcucuccugguucaagaaggggagcuccaucggcaagauguucgaggccaccgcccgcggggcccggcgcauggccauccugggcgacaccgcgugggacuucgggagcaucggcggcguguucacguccgucgggaagcuggugcaccagaucuucggcgccgccuacgggguccuguucagcggcgucuccuggaccaugaagaucgggaucggcgugcugcugaccuggcucggccugaacagccgcuccaccagccuguccaugacgugcaucgccguggggcucgucacccuguaccugggcgugauggugcaggccgacagcgggugcgucaucaacuggaagggccgggagcucaagugcggguccggcaucuucgugaccaacgaggugcacaccuggacggagcaguacaaguuccaggcggacagccccaagcgccugagcgccgccaucggcaaggccugggaggagggggucugcggcauccgguccgugacccgccuggagaacaucauguggaagcagaucagcaacgagcucaaccacauccugcuggagaacgacaugaaguucaccguggucgugggggacguggucggcauccucgcccaggggaagaagaugauccggccccagcccauggagcacaaguacuccuggaaguccuggggcaaggcgaagaucaucggcgccgacgugcagaacaccaccuucaucaucgacgggccgaacacgcccgagugccccgacgaccagcgcgccuggaacaucugggagguggaggacuacggcuucgggaucuucaccaccaacaucuggcugaagcugcgggacuccuacacccaggccugcgaccaccgccucaugagcgcggccaucaaggacuccaaggccguccacgccgacaugggcuacuggaucgagagcgagaagaacgagacguggaagcuggcccgggcguccuucaucgaggugaagaccugcaucuggcccaagagccacacccugugguccaacggcgugcucgagagcgagauggucaucccgaagaucuacgggggccccaucucccagcacaacuaccgccccggguacuucacccagacggccggcccguggcaccuggggaagcuggagcucgacuucgaccugugcgagggcaccaccgugguggucgacgagcacugcggcaaccgggggcccagccugcgcaccacgaccgugaccggcaagaucauccacgaguggugcugccgguccugcacccugccgccccuccgcuucaagggggaggacggcugcugguacgggauggagauccggccggugaaggagaaggaggagaaccuggucaagagcaugguguccgccggcagcggcgagguggacagcuucucccucgggcugcugugcaucagcaucaugaucgaggaggucaugcgcucccgguggagccgcaagaugcucaugacgggcacccuggccguguuccugcuccugaucauggggcagcugaccuggaacgaccucauccggcugugcaucauggugggcgccaacgcguccgaccgcauggggaugggcaccacguaccuggcccucauggccaccuucaagaugcgccccauguucgccgucgggcugcuguuccggcgccucaccagccgggaggugcugcugcucaccaucgggcugucccuggucgccagcguggagcuccccaacucccuggaggagcugggcgacgggcucgcgaugggcaucaugauccugaagcugcucacggacuuccagagccaccagcugugggccacccugcucucccugaccuucaucaagaccacgcugagccuccacuacgccuggaagaccauggccauggugcuguccaucgucagccuguucccccucugccuguccaccaccagccagaagacgaccuggcugccggugcuccugggcucccuggggugcaagccccucaccauguuccugaucgcggagaacaagaucuggggccgcaagagcuggccccugaacgaggggaucauggccgugggcgucguguccauccuccugagcagccugcucaagaacgacgugccccuggccgggccgcugaucgccggcggcaugcucaucgccugcuacgucaucuccgggagcuccgcggaccugagccuggagaaggccgccgagguguccugggaggaggaggccgagcacagcggcgccucccacaacauccucguggagguccaggacgacgggaccaugaagaucaaggacgaggagcgggacgacacgcugaccauccugcucaaggcgacccugcuggccgugagcggcguguacccccucuccauccccgccacccuguucgucugguacuucuggcagaagaagaagcagcgcagcggggugcugugggacacccccuccccgcccgagguggagcgggccguccuggacgacggcaucuaccgcaucaugcagcggggccuccuggggcgcagccaggugggcgugggggucuuccaggagaacguguuccacacgauguggcacgugacccggggcgccguccugauguaccaggggaagcgccucgagcccuccugggcgagcgugaagaaggaccugaucuccuacggcggcggguggcggcugcagggcagcuggaacaccggggaggaggugcaggucaucgccguggagcccggcaagaacccgaagaacgugcagaccgcccccgggacguucaagacccccgagggcgaggucggcgccaucgcccucgacuucaagcccgggaccuccggcagcccgaucgugaaccgcgaggggaagaucgugggccuguacggcaacggggucgugaccacguccggcaccuacgugagcgcgaucgcccaggccaaggccagccaggaggggccccugcccgagaucgaggacgaggucuuccggaagcgcaaccucaccaucauggaccugcacccgggcuccgggaagacccggcgcuaccugcccgcgaucgugcgggaggccaucaagcgcaagcuccggacgcugauccuggcccccacccgcguggucgccagcgagauggccgaggcgcucaagggcaugcccauccgcuaccagaccaccgccgugaaguccgagcacacgggcaaggagaucguggaccugaugugccacgccaccuucaccaugcggcugcucagcccgguccgcgugcccaacuacaacaugaucaucauggacgaggcccacuucaccgaccccuccagcaucgccgcgcggggguacaucuccacgcgcgugggcaugggggaggccgccgccaucuucaugaccgccacgccgcccggcagcgucgaggcguucccccaguccaacgccgugauccaggacgaggagcgggacauccccgagcgcagcuggaacuccggguacgaguggaucaccgacuuccccggcaagacggugugguucguccccagcaucaaguccggcaacgacaucgccaacugccugcggaagaacgggaagcgcgugauccagcugagccggaagaccuucgacaccgaguaccagaagaccaagaacaacgacugggacuacguggucacgaccgacaucuccgagaugggcgccaacuuccgcgcggaccgggugaucgacccccgccggugccucaagcccgucauccugaaggacgggcccgagcgcgugauccuggccggcccgaugcccgugaccgucgccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacgcccgagggcaucaucccggcccucuucgagcccgagcgggagaaguccgccgccaucgacggggaguaccgccugcgcggcgaggcgcggaagaccuucguggagcugaugcgccgcggggaccuccccguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccgcuggcccuccgggaguucaaggaguucgccgcgggccgccgguccgucagcggggaccugauccuggagaucggcaagcucccccagcaccugacgcagcgcgcccagaacgcccuggacaaccucgugaugcugcacaacuccgagcagggcgggcgggccuaccgccacgcgauggaggagcugcccgacaccaucgagacccucaugcugcuggcccucaucgccgugcugaccggcggggucacgcuguucuuccucagcggccgggggcugggcaagaccuccaucggccugcucugcgugauggccagcuccgugcugcuguggauggccagcgucgagccccacuggaucgcggccuccaucauccucgaguucuuccugauggugcugcucaucccggagcccgaccgccagcggacgccccaggacaaccagcuggccuacguggucaucgggcuccucuucaugauccugaccguggccgccaacgagaugggccugcucgagaccacgaagaaggaccuggggaucggccacguggcggucgagaaccaccaccacgccaccaugcuggacguggaccuccacccggccagcgccuggacccuguacgccguggcgaccacgaucaucacccccaugaugcgccacaccaucgagaacaccacggccaacaucucccugaccgccaucgccaaccaggccgcgauccucauggggcuggacaagggcuggcccaucagcaagauggacaucggcgucccccugcucgcccuggggugcuacucccaggugaacccgcugacccucaccgccgccgugcugaugcuggucgcgcacuacgccaucaucggccccgggcuccaggccaaggccacgcgggaggcccagaagcgcaccgcggccggcaucaugaagaaccccaccguggacgggaucguggccaucgaccuggaccccgucguguacgacgccaaguucgagaagcagcugggccagaucaugcuccugauccugugcaccagccagauccuccugaugcgcacgaccugggcccugugcgaguccaucacccucgcgaccggcccgcugacgacccugugggaggggagccccggcaaguucuggaacaccaccaucgccguguccauggccaacaucuuccgggggagcuaccucgccggcgccggccuggcguucucccugaugaagucccucgggggcgggcgccggggcacgggggcccagggcgagacccugggcgagaaguggaagcgccagcugaaccagcucagcaaguccgaguucaacaucuacaagcggagcgggaucauggaggucgaccgcuccgaggccaaggagggccugaagcgcggggagaccacccgccacgccgugagccggggcacggcgaagcugcgcugguucguggagcggaaccuggucaagcccgaggggaaggugaucgaccucggcugcggccgcgggggcugguccuacuacugcgccgggcugaagaaggugaccgaggucaagggcuacaccaagggcgggcccggccacgaggagccgauccccauggccaccuacggguggaaccuggugaagcuccacagcggcaaggacguguucuucacgccgcccgagaagugcgacacccugcugugcgacaucggggaguccagcccgaaccccaccaucgaggagggccggacccuccgcguccugaagaugguggagcccuggcugcgggggaaccaguucugcaucaagauccucaaccccuacaugccguccguggucgagacgcuggagcagaugcagcgcaagcacggcggcaugcuggugcggaacccccucagccgcaacuccacccacgagauguacugggugagcugcgggaccggcaacaucgucuccgccgugaacaugaccagccggaugcugcugaaccgcuucaccauggcccaccgcaagcccacguacgagcgggacguggaccucggggcgggcacccgccacgucgccguggagcccgaggucgccaaccuggacaucaucggccagcggaucgagaacaucaagcacgagcacaaguccaccuggcacuacgacgaggacaacccguacaagaccugggccuaccacgggagcuacgaggugaagcccuccggcagcgccuccagcauggugaacggggucgugaagcugcucacgaagcccugggacgugauccccauggucacccagaucgcgaugaccgacaccacgccguucggccagcagcgcguguucaaggagaagguggacacccggacccccaaggccaagcgcgggaccgcccagaucauggaggucacggcccgguggcuguggggcuuccugagccgcaacaagaagccccggaucugcacccgcgaggaguucacccggaaggugcgcuccaacgccgcgaucggcgccguguucgucgacgagaaccaguggaacagcgccaaggaggccguggaggacgagcgguucugggaccucgugcagaaggagcgcgagcugcacaagcaggggaagugcgcgaccugcgucuacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccggcgggaacauguacgcggacgacacggccgggugggacacccgcaucaccgaggacgaccugcagaacgaggccaagaucaccgacaucauggagcccgagcacgcccugcucgccacgagcaucuucaagcugaccuaccagaacaaggugguccgggugcagcgccccgcgaagaacgggaccgugauggacgucaucucccgccgggaccagcgcggcagcggccaggugggcaccuacggccugaacacguucaccaacauggaggcccagcucauccggcagauggaguccgaggggaucuuccugcccagcgagcuggagaccccgaaccucgccgagcgcgugcuggacuggcuggagaagcacggcgucgagcggcucaagcgcauggccaucuccggggacgacugcguggugaagcccaucgacgaccgguucgccaccgcgcugacggcccugaacgacaugggcaagguccgcaaggacaucccccagugggagcccagcaagggguggaacgacuggcagcaggucccguucugcucccaccacuuccaccagcucaucaugaaggacggccgggagaucgugguccccugccgcaaccaggacgagcuggugggccgggcccgcgugagccagggggccggcuggucccugcgggagaccgccugccucggcaagagcuacgcgcagauguggcagcugauguacuuccaccgccgggaccugcgccucgccgccaacgccaucugcagcgcgguccccguggacugggugcccaccucccggaccacguggagcauccacgcccaccaccaguggaugaccaccgaggacaugcuguccgucuggaaccgcguguggaucgaggagaacccguggauggaggacaagacccacgugagcuccuggggcgacguccccuaccuggggaagcgggaggaccaguggugcggcagccucaucggccugacggcccgcgccaccugggccuccaacauccagguggcgaucaaccaggugcgccggcugaucgggaacgagaacuaccucgacuacaugaccagcaugaagcgcuucaagaacgagggcgaccccgagggggcccugugguga

SEQ ID NO: 8611 - RNA, 9879 nt, Artificial Sequence
  derived and/or modified CDS sequence (opt1) from DENV-1__GU131688__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaugacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccguggggcuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccgcccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgccacccuguucgucugguacuucuggcagaagaagaagcagcgcuccggggugcugugggacacgcccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcccccgggaccuucaagaccagcgagggcgaggucggcgcgaucgcccucgacuucaagcccgggaccuccggcagccccaucgugaaccgcgaggggaagaucgugggccuguacggcaacggggucgugacgaccagcggcaccuacguguccgccaucgcccaggcgaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggccccgacccgcguggucgcgagcgagauggccgaggcccucaagggcaugcccauccgcuaccagaccacggccgugaaguccgagcacaccggcaaggagaucguggaccugaugugccacgccaccuucaccaugcggcugcucagccccguccgcgugcccaacuacaacaugaucaucauggacgaggcgcacuucacggacccguccagcaucgccgcccggggguacaucuccacccgcgugggcaugggggaggccgccgcgaucuucaugaccgccacgccgcccggcagcgucgaggccuucccccaguccaacgccgugauccaggacgaggagcgggacaucccggagcgcagcuggaacuccggguacgaguggaucacggacuuccccggcaagaccgugugguucguccccagcaucaaguccggcaacgacaucgcgaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgccagcgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccccagcaccugacccagcgcgcccagaacgcgcuggacaaccucgugaugcugcacaacuccgagcagggcgggcgggccuaccgccacgccauggaggagcugccggacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucacccccaugaugcgccacaccaucgagaacaccacggccaacaucucccugaccgcgaucgccaaccaggccgccauccucauggggcuggacaagggcuggccgaucagcaagauggacaucggcgucccccugcucgcgcuggggugcuacucccaggugaacccccugacccucaccgccgccgugcugaugcuggucgcccacuacgccaucaucggccccgggcuccaggcgaaggccacgcgggaggcccagaagcgcaccgccgccggcaucaugaagaacccgaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagccccggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacaccaagggcgggcccggccacgaggagcccauccccauggcgacguacggguggaaccuggugaagcuccacagcggcaaggacguguucuucaucccgcccgagaagugcgacacccugcugugcgacaucggggaguccagccccaaccccaccaucgaggagggccgcacccuccggguccugaagaugguggagccguggcugcgcgggaaccaguucugcaucaagauccucaaccccuacaugcccuccguggucgagacgcuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucaccauggcccaccgcaagccgacguacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcgcagaucauggaggucacggccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgaagaucaccgacaucauggagcccgagcacgcccugcucgccaagagcaucuucaagcugacguaccagaacaaggugguccgcgugcagcggccggccaagaacgggaccgugauggacgucaucucccgccgcgaccagcggggcagcggccaggugggcaccuacggccugaacaccuucacgaacauggaggcccagcucauccgccagauggaguccgaggggaucuucagccccuccgagcuggagacccccaaccuggcgggccgggugcucgacuggcuggagaagcacggggucgagcgccugaagcggauggccaucagcggcgacgacugcguggugaagcccaucgacgaccgcuucgccgccgcccucaccgcgcugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgccgucccgguggacugggugcccacgagccgcaccaccugguccauccacgcgcaccaccaguggaugaccacggaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcccgggccaccugggccacgaacauccaggucgccaucaaccaggugcgccgccugaucggcaacgagaacuaccuggacuacaugaccagcaugaagcgguucaagaacgaguccgacccggagggggcgcucugguga

SEQ ID NO: 8612 - RNA, 9879 nt, Artificial Sequence
  derived and/or modified CDS sequence (opt1) from DENV-1__GU131689__SS-prME
agcgugaccauguuccugaugcucaugcccaccgcccuggccuuccaccugaccacccggggcggggagccccacaugaucgugagcaagcaggagcggggcaagagccuccuguucaagaccagcgccggggugaacaugugcacccugaucgccauggaccucggggaguucugcgaggacacgaugaccuacaagugcccccggaucaccgaggccgagcccgacgacguggacugcuggugcaacgccaccgacaccugggugaccuacgggaccugcagccagaccggggagcaccggcgggacaagcgguccguggcccuggcgccccacgugggccuggggcucgagacgcgcaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccagcacggagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccagcggggccuccaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccagaucaaguacgagggcaccgacgcccccugcaagauccccuucuccacccaggacgagaagggggugacccagaacggccggcucaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccugggcgacaccgccugggacuucgggagcaucggcggcguguucacguccgucgggaagcucgugcaccagaucuucggcaccgccuacggggugcuguucagcggcgucuccuggaccaugaagaucgggaucggcgugcugcucaccuggcugggccugaacagccgcuccacgagccucuccaugaccugcaucgccguggggcuggucacccuguaccucggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccucgagaacaucauguggaagcagaucagcaacgagcugaaccacauccugcucgagaacgacaugaagcugaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcguguggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccucuuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucauccgcacgaccuucagccuccacuacgccuggaagaccauggcgauggugcuguccaucgugagccuguucccccucugccuguccaccacgagccagaagaccaccuggcugcccguccuccugggcucccuggggugcaagccgcucaccauguuccugaucgccgagaacaagaucuggggccgcaagagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggacgaugaagaucaaggacgaggagcgcgacgacacccugaccauccugcucaaggccacccugcuggccgugagcggcgucuacccgcucuccauccccgccacccuguucgugugguacuucuggcagaagaagaagcagcggagcggggugcugugggacacgcccagcccgcccgaggucgagcgcgccgugcucgacgacggcaucuaccggaucaugcagcgcggccugcuggggcggagccaggugggcgucgggguguuccaggagaacguguuccacaccauguggcacgucacccgcggcgcggugcugauguaccaggggaagcggcucgagcccuccugggccagcgugaagaaggaccugaucuccuacggcggcggguggcgccugcagggcagcuggaacaccggggaggagguccaggugaucgccguggagcccggcaagaaccccaagaacguccagacggcccccgggaccuucaagaccuccgagggcgaggugggcgccaucgcgcucgacuucaagcccgggaccagcggcagccccaucgugaaccgggaggggaagaucgucggccuguacggcaacgggguggugacgaccuccggcaccuacgucagcgccaucgcccaggccaaggcgucccaggaggggccccugccggagaucgaggacgagguguuccgcaagcggaaccucaccaucauggaccugcaccccggcagcgggaagacgcgccgguaccugcccgccaucgugcgcgaggccaugaagcggcgccuccgcacccugauccuggccccgacccgggucguggccuccgagauggcggaggcccucaagggcaugcccauccgcuaccagaccacggccgucaagagcgagcacaccggcaaggagaucgucgaccugaugugccacgccaccuucaccaugcggcugcucucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccugcggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccucaagccggucauccugaaggacgggcccgagcgcgugauccuggccggccccaugcccgucaccguggccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccggcugcgcggcgaggcccggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgcggccggccgccggagcguguccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccguccugacgggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucgggcuccucuucaugauccugaccguggccgcgaacgagaugggccugcucgagacgaccaagaaggaccuggggaucggccacgucgccguggagaaccaccaccacgccgccaugcuggacguggaccuccaccccgccuccgcguggacccuguacgccgucgccaccacgaucaucacccccaugaugcgccacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggugaacccccugacccucaccgcggccguccugaugcugguggcccacuacgccaucaucggccccgggcuccaggccaaggcgacgcgcgaggcccagaagcggaccgccgccggcaucaugaagaacccgaccguggacgggaucgucgccaucgaccuggaccccgugguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgucagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcgggcccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgcuucaccauggcccaccggaagccgacguacgagcgcgacgucgaccucggggccggcacccggcacguggccguggagcccgaggaggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcgcccggccaagaacgggaccgugauggacgucaucagccggcgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacgugagcuccuggggcgacguccccuaccugggcaagcgcgaggaccaguggugcggcagccugaucgggcucaccgcccgcgcgacgugggccaccaacauccagguggccaucaaccaggugcggcgccugcugggcaacgagaacuaccucgacuacaugaccuccaugaagcgguucaagaacgagagcgacccggagggggcccugugguga

SEQ ID NO: 8613 - RNA, 9879 nt, Artificial Sequence
  derived and/or modified CDS sequence (opt1) from DENV-1__GU131690__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgucacccgccucgagaacaucauguggaagcagaucuccaacgagcugaaccacauccugcucgagaacgacaugaaguucacggugguggucggggacguggccggcauccuggcccaggggaagaagaugauccggccccagcccauggagcacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucgucgggcagcugaccuggaacgaccucauccgccugugcaucauggugggcgccaacgccagcgaccgcauggggaugggcaccaccuaccuggcgcucauggccacguucaagaugcggccgauguucgccgugggccugcuguuccgccggcucaccucccgcgagguccugcugcucaccaucgggcugagccugguggccuccgucgagcuccccaacagccuggaggagcugggcgacgggcucgccaugggcaucaugauccugaagcugcucaccgacuuccagucccaccagcugugggcgacgcugcucagccugaccuucaucaagaccaccuucucccugcacuacgccuggaagacgauggccauggugcucagcguggucucccuguucccccugugccucagcaccaccucccagaagaccacguggcugcccgugcugcucggcagccuggggugcaagccgcugaccauguuccucaucgccgagaacaagaucuggggccggcgcuccuggccccugaacgaggggaucauggcggugggcaucgucagcauccugcucagcucccugcugaagaacgacgugccccucgccgggccccugaucgccggcggcaugcugaucgccugcuacgugaucagcggguccagcgccgaccucucccuggagaaggcggccgaggucagcugggaggaggaggccgagcacuccggcgccagccacaacauccugguggaggugcaggacgacgggaccaugaagaucaaggacgaggagcgggacgacacccucaccauccugcugaaggccacgcuccuggcggucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggccuccgucaagaaggaccucaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacccucauccuggcccccacgcgggugguggccuccgagauggccgaggcccugaagggcaugcccauccgcuaccagaccaccgcggucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccugaagcccgugauccucaaggacgggcccgagcgcgucauccuggcgggccccaugccggugaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgcgagaaguccgccgccaucgacggggaguaccggcuccgcggcgaggcccggaagacguucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacccagcgcgcgcagaacgcccuggacaaccuggucaugcuccacaacagcgagcagggcgggcgggccuaccgccacgccauggaggagcugcccgacacgaucgagacccugaugcuccuggcgcugaucgccgugcucaccggcggggugacccuguucuuccuguccggccgggggcucggcaagaccagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggccguggagaaccaccaccacgcggccaugcuggacgucgaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggucaacccccugacgcugaccgccgccgugcucaugcugguggcgcacuacgccaucaucggcccggggcugcaggccaaggccacccgcgaggcccagaagcggaccgcggccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgccgucucccgcggcaccgcgaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcccaccggaagcccaccuacgagcgcgacguggaccugggggcgggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcugaccaagcccugggacgugauccccauggugacccagaucgcgaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgccgcgaucggcgccguguucguggacgagaaccaguggaacuccgccaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgcggacgacaccgccggcugggacacccggaucacggaggacgaccuccagaacgaggcccgcaucaccgacaucauggagccggagcacgcccugcuggccaaguccaucuucaagcucaccuaccagaacaagguggugcgcguccagcggcccgcgaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccgagcgcgugcuggacuggcucgagaaguacggcguggagcggcugaagcgcauggccaucuccggggacgacugcgucgugaagccgaucgacgaccgguucgccacggcgcugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgccugccuggggaaguccuacgcgcagauguggcagcugauguacuuccaccgccgggaccuccgccuggccgccaacgccaucugcagcgcggugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggccaccaacauccagguggcgaucaaccaggugcgccggcucaucgggaacgagaacuaccuggacuacaugaccuccaugaagcgcuucaagaacgagagcgaccccgagggcgcccugugguga

SEQ ID NO: 8614 - RNA, 9879 nt, Artificial Sequence
  derived and/or modified CDS sequence (opt1) from DENV-1__GU131695__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgggaugaaguucacggugguggucggcgacguggccgggauccucgcgcagggcaagaagaugauccggccccagcccauggaguacaaguacagcuggaaguccuggggcaaggccaagaucaucggggccgacgugcagaacaccaccuucaucaucgacggccccaacaccccggagugccccgacgaccagcgcgccuggaacaucugggaggucgaggacuacggguucggcaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccguggucguggacgagcacugcgggaaccggggcccgucccugcgcaccaccacggugaccgggaagaucauccacgaguggugcugccggaccugcacccugccgccccuccgcuuccggggcgaggacgggugcugguacggcauggagauccgccccgucaaggagaaggaggagaaccuggugaaguccaugguguccgccggcagcggggaggucgacagcuucucccucggccugcugugcaucagcaucaugaucgaggaggugaugcggucccgcuggagccggaagaugcucaugacggggacccuggccguguucuuccugcucaucaugggccagcugaccuggaacgaccugauccgccucugcaucauggucggggccaacgcguccgaccgcaugggcaugggcaccacguaccuggcccugauggccaccuucaagaugcggccgauguucgccguggggcuccuguuccgccggcugaccagccgcgaggugcuccugcugaccaucgggcucucccuggucgccagcguggagcugcccaacucccucgaggagcugggggacggccuggcgaugggcaucaugauccucaagcugcugacggacuuccagagccaccagcucugggccacccugcugucccucaccuucaucaagaccacguucagccugcacuacgccuggaagaccauggccaugguccuguccaucgugagccucuucccccugugccuguccaccaccagccagaagacgaccuggcuccccgugcugcuggggucccucggcugcaagccgcugaccauguuccugaucgcggagaacaagaucugggggcggcgcagcuggccccucaacgagggcaucauggccgucgggaucguguccauccugcugagcagccuccugaagaacgacgugccccuggccggcccccucaucgccggcgggaugcugaucgccugcuacgucaucuccggcagcuccgcggaccugagccucgagaaggccgccgagguguccugggaggaggaggccgagcacagcggggccucccacaacauccugguggagguccaggacgacggcaccaugaagaucaaggacgaggagcgggacgacacccugacgauccuccugaaggcgacccugcucgccgugagcgggguguacccgcuguccauccccgccacccuguucgucugguacuucuggcagaagaagaagcagcgcagcggcgugcucugggacacccccagcccgcccgagguggagcgggccguccuggacgacggcaucuaccgcaucaugcagcgggggcugcugggccgcagccaggugggggugggcgucuuccaggagaacguguuccacacgauguggcacgugacccgcggggccguccucauguaccagggcaagcgccuggagcccuccugggcgagcgugaagaaggaccugaucuccuacggcgggggcuggcggcuccaggggagcuggaacaccggcgaggaggugcaggucaucgccguggagcccgggaagaaccccaagaacgugcagaccgcccccggcacguucaagacccccgagggcgaggucggggccaucgcccuggacuucaagcccggcaccuccgggagccccaucgugaaccgcgagggcaagaucgugggccuguacgggaacggcgucgugaccacguccgggaccuacgugagcgcgaucgcccaggccaaggccagccaggagggcccgcuccccgagaucgaggacgaggucuuccggaagcgcaaccugaccaucauggaccugcaccccggguccggcaagacccggcgcuaccucccggcgaucgugcgggaggccaucaagcgcaagcugcgcacgcugauccucgcccccacccggguggucgccagcgagauggccgaggcgcugaagggcaugcccauccgcuaccagaccaccgccgugaaguccgagcacacggggaaggagaucguggaccugaugugccacgccaccuucaccaugcggcuccugagccccguccgcgugccgaacuacaacaugaucaucauggacgaggcccacuucaccgaccccuccagcaucgccgcgcggggcuacaucuccacgcgcguggggaugggcgaggccgccgccaucuucaugaccgccacgccgcccgggagcgucgaggcguucccgcaguccaacgccgugauccaggacgaggagcgggacauccccgagcgcagcuggaacuccggcuacgaguggaucaccgacuuccccggcaagacggugugguucguccccagcaucaaguccgggaacgacaucgccaacugccugcggaagaacggcaagcgcgugauccagcucagccggaagaccuucgacaccgaguaccagaagaccaagaacaacgacugggacuacguggucacgaccgacaucuccgagaugggggccaacuuccgcgcggaccgggugaucgacccgcgccggugccugaagcccgugauccugaaggacggccccgagcgcgucauccucgccgggcccaugccggugaccgucgccagcgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacgcccgaggggaucauccccgcccuguucgagccggagcgcgagaaguccgccgccaucgacggcgaguaccggcugcgcggggaggcgcggaagaccuucguggagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccccucgcccugcgggaguucaaggaguucgccgcggggcgccgguccgucagcggcgaccugauccucgagaucggcaagcugccgcagcaccugacgcagcgcgcccagaacgcccucgacaaccuggugaugcugcacaacuccgagcagggcgggcgggccuaccgccacgcgauggaggagcuccccgacaccaucgagacccugaugcugcucgcccugaucgccgugcugaccgggggcgucacccucuucuuccugagcgggcggggccugggcaagacguccaucgggcuccugugcgugauggccagcuccgugcugcucuggauggccagcgucgagccccacuggaucgcggccuccaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccacgaagaaggaccugggcaucgggcacguggcggucgagaaccaccaccacgccgccaugcucgacguggaccugcaccccgccagcgccuggacccuguacgcgguggccaccaccaucaucacgccgaugaugcgccacaccaucgagaacaccaccgccaacaucucccucacggccaucgccaaccaggcggccauccugaugggccuggacaagggcuggcccaucagcaagauggacaucggggucccccuccuggcccugggcugcuacucccaggugaacccccucacccugaccgccgcggugcugaugcucgucgcccacuacgccaucaucgggccgggccugcaggccaaggccacccgcgaggcgcagaagcggacggccgccgggaucaugaagaaccccaccguggacggcaucguggccaucgaccuggaccccgucguguacgacgccaaguucgagaagcagcucggccagaucaugcugcugauccucugcaccagccagauccugcugaugcgcaccacgugggcgcucugcgaguccaucacccuggccaccgggccccugaccacgcucugggagggcagcccggggaaguucuggaacaccaccaucgccguguccauggccaacaucuuccggggcagcuaccuggccggcgcggggcuggccuucucccucaugaagucccugggcgggggccgccgggggaccggcgcccagggcgagacgcugggggagaaguggaagcgccagcucaaccagcugagcaaguccgaguucaacaccuacaagcggagcggcaucauggaggucgaccgcuccgaggccaaggaggggcugaagcggggcgagaccaccaagcacgcggugagccgcgggacggccaagcuccggugguucguggagcgcaaccuggucaagcccgagggcaaggugaucgaccugggcugcgggcggggcgggugguccuacuacugcgccggccugaagaaggugaccgaggucaagggguacaccaagggcggccccgggcacgaggagcccaucccgauggccaccuacggcuggaaccucgugaagcugcacagcgggaaggacguguucuucaucccgcccgagaagugcgacacgcugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacccacgagauguacugggugagcugcggcacggggaacaucgucuccgccgugaacaugaccagccgcaugcugcucaaccgcuucaccauggcgcaccggaagcccaccuacgagcgcgacguggaccugggcgccggcacgcggcacgucgccguggagcccgagguggccaaccuggacaucaucgggcagcgcaucgagaacaucaagcacgagcacaaguccaccuggcacuacgacgaggacaaccccuacaagaccugggccuaccacggcagcuacgaggucaagccguccgggagcgcguccagcauggugaacggcgucgugaagcuccugaccaagcccugggacgugauccccauggucacgcagaucgccaugaccgacaccacccccuucgggcagcagcggguguucaaggagaagguggacacgcgcaccccgaaggccaagcggggcaccgcccagaucauggaggucaccgccaaguggcuguggggcuuccucagccgcaacaagaagccccggaucugcacgcgcgaggaguucacccggaaggugcgcuccaacgcggccaucggggccguguucgucgacgagaaccaguggaacagcgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaagauccccggcggcaacauguacgccgacgacaccgccgggugggacacgcggaucaccgaggacgaccugcagaacgaggcccgcaucaccgacaucauggagccggagcacgcccuccuggcgcgcagcaucuucaagcugaccuaccagaacaaggugguccgggugcagcgccccgccaagaacggcacggugauggacgucaucucccggcgcgaccagcgggggagcggccaggugggcaccuacgggcucaacaccuucaccaacauggaggcccagcugauccgccagauggaguccgagggcaucuucagccccuccgagcuggagacgcccaaccucgccgagcgggugcuggacuggcuggagaaguacggggucgagcgccucaagcggauggccaucagcggcgacgacugcguggugaagccgaucgacgaccgcuucgcgaccgcccugaccgcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugucccagggcgccggguggagccugcgcgagaccgcgugccucggcaagagcuacgcccagauguggcagcugauguacuuccaccggcgcgaccugcggcucgccgccaacgcgaucugcuccgccguccccguggacuggauccccacgagccgcaccaccugguccauccacgcccaccaccaguggaugaccacggaggacaugcugagcguguggaaccgcgucuggaucgaggagaaccccuggauggaggacaagacccacaucuccagcuggggcgacgugccguaccugggcaagcgggaggaccaguggugcggcucccucaucgggcugaccgcccgcgccaccugggcgaccaacauccagguggccaucaaccagguccggcgccugaucggcaacgagaacuaccucgacuacaugacgagcaugaagcgguucaagaacgaguccgaccccgagggggcccugugguga

SEQ ID NO: 8615 - RNA, 9879 nt, Artificial Sequence
  derived and/or modified CDS sequence (opt1) from DENV-1__GU131697__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccaguaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaacaagcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccggcucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccgccggauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaagcucaccgucguggugggggacgucgcgggcauccuggggcagggcaagaagaugauccgcccccagcccauggaguacaaguacagcuggaaguccuggggcaaggccaagaucaucggggccgacgcccagaacacgaccuucaucaucgacggccccaacaccccggagugccccgacgaccagcgggcguggaacaucugggagguggaggacuacggguucggcaucuucaccacgaacaucuggcugaagcuccgcgacagcuacacccaggugugcgaccaccggcugauguccgccgccaucaaggacagcaaggccguccacgccgacaugggcuacuggaucgaguccgagaagaacgagaccuggaagcuggcgcgcgccagcuucaucgaggugaagaccugcaucuggcccaagucccacacgcucuggagcaacggggugcuggaguccgagaugaucauccccaagaucuacggcgggccgaucagccagcacaacuaccggcccggcuacuucacccagaccgccgggcccuggcaccugggcaagcucgagcuggacuucgaccugugcgagggcaccacggucgugguggacgagcacugcgggaaccgcggcccgucccuccggaccaccaccgucacggggaagaucauccacgaguggugcugccgcagcugcacccugccgccccugcgguuccgcggcgaggacgggugcugguacggcauggagauccggcccgugaaggagaaggaggagaaccucgugaaguccauggucagcgccggcagcggggagguggacuccuucagccugggccugcucugcaucuccaucaugaucgaggaggugaugcgcagccgguggucccgcaagaugcugaugaccgggacccuggccgucuucuuccuccugaucaugggccagcugacguggaacgaccucauccggcugugcaucauggugggggcgaacgccuucgaccgcaugggcaugggcaccaccuaccuggcccucauggccaccuucaagaugcgcccgauguucgccguggggcugcuguuccggcgccucacgagccgggagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcgcaagagcuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgggacgacacccucaccauccugcugaaggccacccuccuggccgugagcggggucuacccgcuguccauccccgccacccucuucgugugguacuucuggcagaagaagaagcagcgcagcggcgugcugugggacacccccagcccgcccgaggucgagcgggccgugcuggacgacggcaucuaccgcaucaugcagcgggggcugcucggccgcagccaggugggggucggcguguuccaggagaacguguuccacaccauguggcacgucacccgcggggccgugcugauguaccagggcaagcgccuggagcccuccugggccagcgugaagaaggaccucaucuccuacggcgggggcuggcggcugcgcgggagcuggaacacgggcgaggagguccaggugaucgccguggagcccgggaagaaccccaagaacguccagaccgcccccggcaccuucaagacccccgagggcgaggugggggccaucgcgcuggacuucaagcccggcacguccgggagccccaucgugaaccgggagggcaagaucgucggccucuacgggaacggcguggugaccaccuccgggaccuacgucagcgccaucgcccaggccaaggcgagccaggagggcccgcugcccgagaucgaggacgagguguuccgcaagcggaaccugacgaucauggaccuccaccccggguccggcaagacccgccgguaccugccggccaucgugcgcgaggccaucaagcggaagcugcgcacccucauccuggcccccacccgcgucguggccagcgagauggcggaggcccugaagggcaugcccauccgguaccagacgaccgccgugaaguccgagcacaccgggaaggagaucgucgaccucaugugccacgccaccuucacgaugcgccugcugagccccgugcgggugccgaacuacaacaugaucaucauggacgaggcccacuucaccgaccccuccagcaucgcggcccgcggcuacaucuccacccgggucgggaugggcgaggccgccgccaucuucaugaccgcgacgccgcccgggagcguggaggccuucccgcaguccaacgccgugauccaggacgaggagcgcgacauccccgagcggagcuggaacuccggccacgaguggaucaccgacuuccccggcaagaccgucugguucgugcccagcaucaaguccgggaacgacaucgccaacugccuccgcaagaacggcaagcgggugauccagcugagccgcaagaccuucgacacggaguaccagaagaccaagaacaacgacugggacuacgucgugaccaccgacaucuccgagaugggggcgaacuuccgggccgaccgcgugaucgacccgcggcgcugccugaagcccgucauccucaaggacggccccgagcgggugauccuggccgggcccaugccggugacggucgccagcgccgcgcagcgccggggccgcaucggccggaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgguggacggcgaguaccgccuccgcggggaggcccgcaagaccuucgucgagcugaugcggcgcggcgaccugcccguguggcucagcuacaagguggccuccgagggcuuccaguacagcgaccggcgcuggugcuucgacggggagcggaacaaccagguccuggaggagaacauggacguggagaucuggacgaaggagggcgagcgcaagaagcugcggccccgcuggcucgacgcccggaccuacagcgacccccuggcccugcgcgaguucaaggaguucgcggccgggcggcgcuccgugagcggcgaccucauccuggagaucggcaagcugccgcagcaccucacccagcgggcccagaacgcccuggacaaccuggucaugcuccacaacuccgagcagggcgggcgcgcguaccggcacgccauggaggagcugcccgacaccaucgagacgcugaugcuccuggcccugaucgccgugcucaccgggggcgugacccuguucuuccugagcgggcgcggccucggcaagaccuccaucgggcugcugugcgucauggccagcuccgugcuccuguggauggcgagcguggagccccacuggaucgccgccuccaucauccuggaguucuuccucaugguccugcugauccccgagccggaccggcagcgcacgccccaggacaaccagcucgccuacguggugaucggccugcuguucaugauccucacggucgccgcgaacgagauggggcugcuggagaccaccaagaaggaccucggcaucgggcacguggccguggagaaccaccaccacgccgccaugcuggacgucgaccugcaccccgccagcgcguggacccucuacgccguggccacgaccaucaucaccccgaugaugcggcacaccaucgagaacacgaccgccaacaucucccugaccgccaucgcgaaccaggccgccauccugaugggccucgacaagggcuggcccaucagcaagauggacaucggggugccccugcuggcccucggcugcuacucccaggucaacccccugacccugacggcggccgugcucaugcugguggcccacuacgccaucaucgggccgggccugcaggccaaggcgacccgcgaggcccagaagcgcaccgccgccgggaucaugaagaaccccaccgucgacggcaucguggccaucgaccucgaccccguggucuacgacgcgaaguucgagaagcagcugggccagaucaugcugcucauccugugcacgagccagauccugcucaugcggaccaccugggcccugugcgaguccaucacccuggccacggggccccucaccacccugugggagggcagcccggggaaguucuggaacaccacgaucgccguguccauggccaacaucuuccgcggcagcuaccuggcgggcgccgggcucgccuucucccugaugaagucccugggcgggggccggcgcgggaccggcgcccagggcgagacccucggggagaaguggaagcggcagcugaaccagcugagcaaguccgaguucaacaccuacaagcgcagcggcaucauggagguggaccgguccgaggcgaaggaggggcucaagcgcggcgagacgaccaagcacgccgucagccgggggaccgccaagcugcgcugguucguggagcggaaccuggugaagcccgagggcaaggucaucgaccugggcugcgggcgcggcgggugguccuacuacugcgccggccucaagaaggugaccgaggugaagggguacacgaagggcggccccgggcacgaggagcccaucccgauggccaccuacggcuggaaccuggucaagcugcacagcgggaaggacguguucuucaucccgcccgagaagugcgacacccuccugugcgacaucggcgaguccagccccaacccgaccaucgaggaggggcggacgcugcgcgugcucaagauggucgagcccuggcugcggggcaaccaguucugcaucaagauccugaaccccuacaugcccuccgugguggagacccucgagcagaugcagcgcaagcacggcgggaugcugguccggaacccgcugagccgcaacuccacccacgagauguacugggugagcugcggcaccgggaacaucguguccgcggucaacaugaccagccggaugcuccugaaccgcuucacgauggcccaccgcaagcccaccuacgagcgggacguggaccugggcaccggcacccgccacguggccgucgagcccgagguggccaaccucgacaucaucgggcagcggaucgagaacaucaagcacgagcacaaguccacguggcacuacgacgaggacaaccccuacaagaccugggccuaccacggcagcuacgaggugaagccguccgggagcgcguccagcauggucaacggcguggucaagcugcugaccaagcccugggacgugauccccauggugacccagaucgccaugacggacaccacccccuucgggcagcagcgcgucuucaaggagaagguggacacccggacgccgaaggccaagcgcggcaccgcccagaucauggaggugaccgcccgguggcucuggggcuuccugagccgcaacaagaagccccggaucugcacccgcgaggaguucacgcggaagguccgcuccaacgcggccaucggggccguguucguggacgagaaccaguggaacagcgccaaggaggcggucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcgucgagggggagggccuccacaagcugggguacauccugcgcgacaucuccaagauccccggcggcaacauguacgccgacgacaccgccgggugggacacccggaucacggaggacgaccuccagaacgaggccaagaucaccgacaucauggagccggagcacgcccugcuggcgaaggccaucuucaagcucaccuaccagaacaagguggugcgcguccagcgccccgccaagaacggcaccgugauggacgugaucagccggcgcgaccagcggggguccggccaggucggcacguacgggcugaacaccuucaccaacauggaggcccagcugauccgccagauggagagcgagggcaucuucucccccagcgagcucgagacccccaaccuggccgagcgggcgcuggacuggcucgagaaguacgggguggagcgccugaagcggauggccaucuccggcgacgacugcguggucaagccgaucgacgaccgcuucgccacggcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucgucgugccgugccggaaccaggacgagcugguggggcgcgcgcgggucagccagggcgccggguggucccuccgcgagaccgccugccugggcaagagcuacgcccagauguggcagcugauguacuuccaccggcgcgaccuccggcuggcggccaacgccaucugcagcgccgugcccguggacuggguccccaccucccgcacgaccuggagcauccacgcccaccaccaguggaugaccaccgaggacaugcuguccguguggaaccggguguggaucgaggagaaccccuggauggaggacaagacgcacaucagcuccugggaggacgucccguaccucgggaagcgcgaggaccaguggugcggcagccugaucggccugaccgcgcgcgccaccugggccaccaacauccagguggccaucaaccaggugcggcgccucaucgggaacgagaacuaccuggacuacaugaccuccaugaagcgguucaagaacgagagcgaccccgagggcgcccugugguga

SEQ ID NO: 8616 - RNA, 9879 nt, Artificial Sequence
  derived and/or modified CDS sequence (opt1) from DENV-1__GU131700__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacucccacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcugacggugagcggcguguacccgcucuccauccccgccacccuguucgucugguacuucuggcagaagaagaagcagcgcagcggggugcugugggacacccccagcccgcccaagguggagcgggccguccucgacgacggcaucuaccgcaucaugcagcggggccugcuggggcgcagccaggugggcgugggggucuuccaggagaacguguuccacaccauguggcacgugacgcggggcgccguccugauguaccaggggaagcgccucgagcccuccugggcgagcgugaagaaggaccugaucuccuacggcggcggguggcggcugcagggcagcuggaacaccggggaggaggugcaggucaucgccguggagcccggcaagaaccccaagaacgugcagaccgcccccgggaccuucaagacguccgagggcgaggucggcgccaucgcccucgacuucaagcccgggaccagcggcagccccaucgugaaccgcgaggggaagaucgugggccuguacggcaacggggucgugaccaccuccggcacguacgugagcgcgaucgcccaggccaaggccucccaggaggggccccugccggagaucgaggacgaggucuuccggaagcgcaaccucaccaucauggaccugcaccccggcagcgggaagacccggcgcuaccugcccgcgaucgugcgggaggccaucaagcgcaagcuccggacccugauccuggccccgacgcgcguggucgccuccgagauggccgaggcgcucaagggcaugcccauccgcuaccagaccaccgccgucaagagcgagcacaccggcaaggagaucguggaccugaugugccacgccacguucaccaugcggcugcucucccccguccgcgugcccaacuacaacaugaucaucauggacgaggcccacuucaccgacccgagcuccaucgccgcgcggggguacaucagcacccgcgugggcaugggggaggccgccgccaucuucaugacggccacgccgcccggcuccgucgaggcguucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgcggaccgggugaucgacccccgccggugccucaagccggugauccugaaggacgggcccgagcgcgucauccuggccggccccaugcccgugaccgucgccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagacguucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacacgaucgagaccaugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagcccgaccgccagcggacgccgcaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccuccgccuggacgcucuacgcgguggccaccaccaucaucacccccaugaugcgccacacgaucgagaacaccaccgccaacaucagccugaccgccaucgccaaccaggcggccauccugauggggcucgacaagggcuggccgaucuccaagauggacaucggcgucccccugcuggcccucgggugcuacagccaggugaacccccugacgcugaccgccgcggugcucaugcuggucgcccacuacgccaucaucggccccgggcugcaggccaaggccacccgggaggcgcagaagcgcaccgccgccggcaucaugaagaacccgacgguggacgggaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccggcccccucaccacccugugggaggggucccccggcaaguucuggaacacgaccaucgccgugagcauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgcggugucccgcggcaccgccaagcugcggugguucguggagcgcaaccuggucaagccggaggggaaggugaucgaccucggcugcggccgcggcggguggagcuacuacugcgccgggcugaagaaggugacggaggucaagggguacaccaagggcggccccggccacgaggagcccauccccauggccaccuacggguggaaccuggugaagcugcacuccggcaaggacguguucuucaucccgcccgagaagugcgacacccuccugugcgacaucggggagagcucccccaaccccacgaucgaggagggccgcacccugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgccgugaacaugacgucccgcaugcuccugaaccgguucaccauggcgcaccgcaagccgaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagcccagcggcagcgcguccagcauggugaacggggucgugaagcugcugaccaagccgugggacgugauccccauggucacccagaucgccaugacggacaccacccccuucggccagcagcggguguucaaggagaagguggacacccgcacgcccaaggccaagcgggggaccgcccagaucauggaggucaccgccaaguggcucuggggcuuccugucccgcaacaagaagccgcggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagcccgagcacgcccugcuggcgaaguccaucuucaagcucaccuaccagaacaaggugguccgcgugcagcggccggccaagaacgggaccgugauggacgucaucagccgccgcgaccagcggggcuccggccaggugggcacguacggccugaacaccuucaccaacauggaggcccagcugauccgccagauggagagcgaggggaucuucucccccagcgagcucgagacccccaaccuggcccggcgcgugcuggacuggcucgagaagcacggcgucgagcggcugaagcgcauggccaucuccggggacgacugcguggugaagcccaucgacgaccgguucgcgacggcccugaccgcccucaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcuggugggccgggcccgcgugucccagggggccggcuggagccuccgggagaccgcgugccuggggaaguccuacgcccagauguggcagcugauguacuuccaccgccgggaccuccgccuggccgccaacgcgaucugcagcgccgucccgguggacugggugcccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugcccuaccucgggaagcgggaggaccaguggugcggcagccugaucggccugaccgcccgcgccaccugggcgaccaacauccaggucgccaucaaccaggugcgccggcucaucgggaacgagaacuaccuggacuacaugaccuccaugaagcgcuucaagaacgagagcgacccggagggcgcccugugguga

SEQ ID NO: 8617 - RNA, 9879 nt, Artificial Sequence
  derived and/or modified CDS sequence (opt1) from DENV-1__GU131701__SS-prME
agcgugaccaugcugcucaugcugaugcccaccgcccuggccuuccaccucaccacccggggcggggagccgcacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaccgcccuguuccuggcccacgugaucggcaccagcaucacgcagaaggggaucaucuucauccuccugaugcuggucacccccuccauggcgaugcggugcgugggcaucggcagccgcgacuucguggaggggcucuccggcgccaccugggucgacguggugcuggagcacgggagcugcgucaccacgauggccaaggacaagcccacccuggacaucgagcuccugaagaccgaggugaccaaccccgccgugcugcggaagcucugcaucgaggccaagaucuccaacacgaccaccgacagccgcugcccgacccagggcgaggcgacgcuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucacggugcacaccggcgaccagcaccaggucgggaacgaguccaccgagcacggcaccaccgccacgaucacgccccaggcccccaccaccgagauccagcucacggacuacggggcgcugacccuggacugcagcccccgcaccggccucgacuucaacgagauggugcugcugaccaugaaggagaaguccuggcucgugcacaagcagugguuccuggaccugccgcuccccuggacgagcggggccagcaccucccaggagaccuggaaccggcaggaccugcuggucaccuucaagacggcccacgccaagaagcaggagguggugguccucggcagccaggagggcgccaugcacaccgcgcugaccggggccaccgagauccagacguccggcaccaccaccaucuucgccgggcaccugaagugccgccucaagauggacaagcugacgcugaagggcaugagcuacgugaugugcaccggguccuucaagcucgagaaggagguggccgagacccagcacggcaccguccuggugcagaucaaguacgagggcacggacgcccccugcaagauccccuucagcacccaggacgagaagggggugacccagaacggccggcugaucaccgcgaacccgacggucaccgacaaggagaagcccgugaacaucgaggccgagccgcccuucggggaguccuacaucaucaucggcgccggcgagaaggcccugaagcucagcugguucaagaagggguccagcaucggcaagauguucgaggcgaccgcccgcggggcccggcgcauggccauccugggcgacaccgccugggacuucggguccaucggcggcguguucacgagcgucgggaagcuggugcaccagaucuucggcaccgcguacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacaccuggacggagcaguacaaguuccaggccgacagcccgaagcgccuguccgccgcgaucggcaaggccugggaggagggggucugcggcauccggagcgccacccgccuggagaacaucauguggaagcagaucuccaacgagcucaaccacauccugcuggagaacgacaugaaguucaccgugguggucggggacguggccggcauccucgcccaggggaagaagaugauccggccccagcccauggaguacaaguacagcuggaaguccuggggcaaggcgaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagaccugcaucuggcccaagucccacacccuguggagcaacggcgugcucgaguccgagaugaucauccccaagaucuacgggggcccgaucagccagcacaaccaccgccccggguacuucacgcagaccgcgggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugaccuggaacgaccugauccgccucugcaucauggucggcgccaacgccagcgaccgcauggggaugggcacgaccuaccuggcgcugauggccaccuucaagaugcggccgauguucgccgugggccuccuguuccgccggcugaccucccgcgaggugcuccugcugacgaucgggcucagccuggucgccuccguggagcugcccaacagccucgaggagcugggcgacgggcuggccaugggcaucaugauccucaagcugcugaccgacuuccagccccaccagcucugggcgacccugcugucccucaccuucaucaagacgaccuucagccugcacuacgccuggaagaccauggccaugguccuguccaucgugagccucuucccccugugccuguccaccacgagccagaagaccaccuggcucccggugcugcugggcucccucgggugcaagccccugaccauguuccugaucgccgagaacaagaucuggggccggcgcagcuggccccucaacgaggggaucauggcggucggcaucguguccauccugcugagcagccuccugaagaacgacgugccccuggccgggccgcucaucgccggcggcaugcugaucgccugcuacgucaucuccgggagcuccgccgaccugagccucgagaaggcggccgagguguccugggaggaggaggccgagcacagcggcgccucccacaacauccugguggagguccaggacgacgggaccaugaagaucaaggacgaggagcgggacgacacgcugaccauccuccugaaggccacccugcucgcggugagcggcguguacccccuguccauccccgccacccuguucgucugguacuucuggcagaagaagaagcagcgcagcggggugcucugggacacgcccuccccgcccgagguggagcgggccguccuggacgacggcaucuaccgcaucaugcagcggggccugcuggggcgcagccaggugggcgugggggucuuccaggagaacguguuccacaccauguggcacgugacccggggcgccguccucauguaccaggggaagcgccuggagcccuccugggccagcgugaagaaggaccugaucuccuacggcggcggguggcggcuccagggcagcuggaacaccggggaggaggugcaggucaucgcgguggagcccggcaagaacccgaagaacgugcagacggcccccgggaccuucaagacccccgagggcgaggucggcgccaucgcccuggacuucaagcccgggaccuccggcagcccgaucgugaaccgcgaggggaagaucgugggccuguacggcaacggggucgugacgaccuccggcaccuacgugagcgccaucgcgcaggccaaggccagccaggaggggccccuccccgagaucgaggacgaggucuuccggaagcgcaaccugaccaucauggaccugcacccgggcuccgggaagacgcggcgcuaccuccccgccaucgugcgggaggcgaucaagcgcaagcugcgcacccugauccucgcccccacccggguggucgccagcgagauggccgaggcccugaagggcaugcccauccgcuaccagaccacggcggugaaguccgagcacaccggcaaggagaucguggaccugaugugccacgccaccuucaccaugcggcuccugagcccgguccgcgugcccaacuacaacaugaucaucauggacgaggcccacuucacggaccccuccagcaucgccgcccggggguacaucuccacccgcgugggcaugggggaggcggccgccaucuucaugaccgccacgccgcccggcagcgucgaggccuucccccaguccaacgcggugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgccaacuuccgcgccgaccgggugaucgacccccgccggugccugaagcccgugauccugaaggacgggcccgagcgcgucauccucgcgggcccgaugcccgugaccgucgccagcgccgcccagcggcgcgggcggaucggccgcaaccacaacaaggagggcgaccaguacaucuacauggggcagccccugaacaacgacgaggaccacgcccacuggacggaggcgaagaugcugcucgacaacaucaacacccccgagggcaucaucccggcccuguucgagcccgagcgcgagaaguccgccgccaucgacggggaguaccggcugcgcggcgaggcccggaagaccuucguggagcucaugcgccgcggggaccugcccguguggcugagcuacaaggucgcguccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacagcgacccgcucgcccugcgggaguucaaggaguucgccgccggccgccgguccgucagcggggaccugauccucgagaucggcaagcugccccagcaccugacccagcgcgcgcagaacgcccucgacaaccuggugaugcugcacaacuccgagcagggcgggcgggccuaccgccacgccauggaggagcuccccgacaccaucgagacccugaugcugcucgcgcugaucgccgugcugaccggcggggucacccucuucuuccugagcggccgggggcugggcaagaccuccaucggccuccugugcgugauggccagcuccgugcugcucuggauggccagcgucgagccccacuggaucgccgcguccaucauccuggaguucuuccugauggugcuccugaucccggagcccgaccgccagcggacgccccaggacaaccagcuggccuacguggucaucgggcuccuguucaugauccugaccguggccgccaacgagaugggccuccuggagacgaccaagaaggaccuggggaucggccacguggccgucgagaaccaccaccacgcggccaugcucgacguggaccugcacccggccagcgccuggacccuguacgccguggcgaccacgaucaucacccccaugaugcgccacaccaucgagaacaccacggccaacaucucccucaccgccaucgccaaccaggccgcgauccugauggggcuggacaagggcuggcccaucagcaagauggacaucggcgucccccuccuggcccuggggugcuacucccaggugaacccgcucacccugaccgccgccgugcugaugcucgucgcgcacuacgccaucaucggccccgggcugcaggccaaggccacgcgcgaggcccagaagcggaccgcggccggcaucaugaagaaccccaccguggacgggaucguggccaucgaccuggaccccgucguguacgacgccaaguucgagaagcagcucggccagaucaugcugcugauccucugcaccagccagauccugcugaugcgcacgaccugggcccucugcgaguccaucacccuggcgaccggcccgcugacgacccucugggaggggagccccggcaaguucuggaacaccaccaucgccguguccauggccaacaucuuccgggggagcuaccuggccggcgccggccuggcguucucccucaugaagucccucgggggcgggcgccgggggacgggggcccagggcgagacccugggcgagaaguggaagcgccagcucaaccagcugagcaaguccgaguucaacaccuacaagcggagcgggaucauggaggucgaccgcuccgaggccaaggagggccugaagcgcggggagaccacgaagcacgccgugagccgcggcaccgcgaagcuccggugguucguggagcgcaaccuggucaagcccgaggggaaggugaucgaccugggcugcggccgcggcgggugguccuacuacugcgccgggcugaagaaggugaccgaggucaagggguacaccaagggcggccccggccacgaggagccgauccccauggccacguacggguggaaccucgugaagcugcacagcggcaaggacgccuucuucaucccgcccgagaagugcgacacccugcucugcgacaucggggaguccagcccgaaccccaccaucgaggagggccgcacccugcgggugcugaagauggucgagcccuggcuccgcgggaaccaguucugcaucaagauccugaaccccuacaugccguccgugguggagacccuggagcagaugcagcggaagcacggcggcaugcucguccgcaacccccugagccggaacuccacgcacgagauguacugggugagcugcgggaccggcaacaucguguccgccaucaacaugaccagccgcaugcugcucaaccgcuucaccauggcgcaccggaagcccacguacgagcgcgacgucgaccugggggccggcacccggcacguggccguggagcccgaggucgccaaccuggacaucaucggccagcgcaucgagaacaucaagcacgagcacaaguccaccuggcacuacgacgaggacaacccguacaagaccugggccuaccacgggagcuacgaggugaagcccuccggcagcgcguccagcauggugaacggggucgugaagcuccugacgaagcccugggacgucauccccauggugacccagaucgccaugaccgacaccacgccguucggccagcagcggguguucaaggagaaggucgacacccgcacccccaaggccaagcgggggaccgcccagaucauggaggugacggccaaguggcuguggggcuuccucagccgcaacaagaagccccggaucugcacccgcgaggaguucacccggaaggugcgcuccaacgcggccaucggcgccgucuucguggacgagaaccaguggaacagcgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcaccgccucggcuacauccugcgggacaucuccaagauccccgggggcaacauguacgccgacgacacggccggcugggacacccgcaucaccgaggacgaccugcagaacgaggcccgcaucaccgacaucauggagcccgagcacgcccuccuggccaagagcaucuucaagcugacguaccagaacaaggucgugcgggugcagcgccccgggaagaacggcaccgucauggacgugaucucccggcgcgaccagcgggggagcggccaggugggcaccuacgggcucaacaccuucacgaacauggaggcccagcugauccgccagauggaguccgagggcaucuucagccccuccgagcuggagaccccgaaccucgccgagcggguccuggacuggcuggagaaguacgggguggagcgccucaagcggauggccaucagcggcgacgacugcguggucaagcccaucgacgaccgcuucgccaccgcgcugaccgcccugaacgacauggggaaggugcggaaggacaucccccagugggagcccuccaagggcuggaacgacuggcagcaggucccguucugcagccaccacuuccaccagcucaucaugaaggacggccgcgagaucgucgugcccugccggaaccaggacgagcugguggggcgcgcccgggucucccagggcgccggguggagccugcgcgagacggccugccucggcaagagcuacgcgcagauguggcagcugauguacuuccaccggcgcgaccugcggcucgccgccaacgccaucugcuccgcggugcccguggacuggauccccaccagccgcaccaccugguccauccacgcccaccaccaguggaugacgaccgaggacaugcugagcgucuggaaccgcguguggaucgaggagaacccguggauggaggacaagacccacaucuccagcuggggcgacgugcccuaccugggcaagcgggaggaccaguggugcggcucccucaucgggcugaccgcccgcgccaccugggccacgaacauccaggucgcgaucaaccaggugcggcgccugaucggcaacgagaacuaccucgacuacaugaccagcaugaagcgguucaagaacgaguccgaccccgagggggcccugugguga

SEQ ID NO: 8618 - RNA, 9879 nt, Artificial Sequence
  derived and/or modified CDS sequence (opt1) from DENV-1__GU131703__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacgcucauccuggcccccacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccucaaggacgggcccgagcgcgugauccuggcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggucaugcuccacaacagcgagcagggcgggcgggccuaccgccacgccauggaggagcugcccgacaccaucgagacccugaugcuccuggcgcugaucgccgugcucaccggcggggugacccuguucuuccuguccggccgggggcucggcaagacgagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcggacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcacggggaacaucgugagcgccgucaacaugaccucccgcaugcuccugaaccgcuucaccauggcccaccggaagcccaccuacgagcgcgacguggaccugggcgcgggcacgcggcacguggccgucgagcccgagguggccaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgggucuucaaggagaagguggacacgcgcaccccgaaggccaagcggggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaagguggugcgcguccagcggcccgcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccaaccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgaccccgagggggcccugugguga

SEQ ID NO: 8619 - RNA, 9879 nt, Artificial Sequence
  derived and/or modified CDS sequence (opt1) from DENV-1__GU131706__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguuccgcaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaugaccuaccuggcccugauggccaccuucaagaugcgcccgauguucgccgugggccuccuguuccggcgccugacgucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccaccuucucccugcacuacgccuggaagaccauggccaugguccugagcaucgugucccucuucccccugugccugagcacgaccucccagaagaccaccuggcuccccgugcugcugggcagccucgggugcaagccgcugacgauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgccguccucauguaccaggggaagcggcuggagcccagcugggcguccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgggaggggaagaucgugggccuguacggcaacggggucgugaccaccagcggcaccuacgugagcgcgaucgcccaggccaaggccucccaggaggggccgcuccccgagaucgaggacgaggucuuccgcaagcggaaccugacgaucauggaccugcaccccggcagcgggaagacccgccgguaccucccggcgaucgugcgcgaggccaucaagcgcaagcugcggacccugauccucgcccccacccgcguggucgccuccgagauggccgaggcgcugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugaccgccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgccaacuuccgggcggaccgcgugaucgacccgcggcgcugccugaagcccgugauccugaaggacgggcccgagcgggucauccucgccggccccaugccggugacggucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugacgguggccgccaacgagaugggccuccuggagaccaccaagaaggaccuggggaucggccacguggcggucgagaaccaccaccacgccgccaugcucgacguggaccugcaccccgccuccgccuggacccuguacgcgguggccacgaccaucaucaccccgaugaugcgccacaccaucgagaacacgaccgccaacaucagccucaccgccaucgccaaccaggcggccauccugauggggcuggacaagggcuggcccaucuccaagauggacaucggcgucccccuccuggcccuggggugcuacagccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgucccagauccugcugaugcggaccaccugggcgcucugcgagagcaucacccuggccacgggcccccugaccacccucugggagggguccccgggcaaguucuggaacaccacgaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggccaaggagggccugaagcgcggggagacgaccaagcacgcggugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugaccucccgcaugcugcucaaccgguucacgauggcgcaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgcgagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgccaaguggcuguggggcuuccucucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccaggugggcaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8620 - RNA, 9879 nt, Artificial Sequence
  derived and/or modified CDS sequence (opt1) from DENV-1__GU131708__SS-prME
agcgugaccaugcugcucaugcugaugcccaccgcccuggccuuccaccucaccacccggggcggggagccccacauggugguguccaagcaggagcggggcaagagccugcuguucaagaccuccgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccuccagcuucaagcucgagaaggagguggcggagacgcagcacgggaccgugcugguccagaucaaguacgagggcaccgacgcccccugcaagauccccuucuccacccaggacgagaagggcgugacgcagaacgggcggcugaucaccgccaacccgaucgugaccgacaaggagaagcccgucaacaucgaggccgagccgcccuucggcgagagcuacaucgugaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgucggcaagcuggugcaccagaucuucgggaccgccuacggcguccuguucagcggggucuccuggaccaugaagaucggccugggggugcugcucacguggcugggccugaacagccgcuccaccagccucuccaugaccugcaucgccgugggccuggucacccuguaccucggggugauggugcaggccgacagcggcugcgucaucaacuggaaggggcgggagcugaagugcggcagcgggaucuucgugacgaacgaggugcacaccuggaccgagcaguacaaguuccaggcggacuccccgaagcgccugagcgccgccaucggcaaggccugggaggagggcgucugcgggauccgguccgccacccgccucgagaacgugauguggaagcagaucagcaacgagcugaaccacauccugcucgagaacgacaugaaguucaccguggucgugggcgacguggcggggauccuggcccagggcaagaagaugauccggccccagcccauggaguacaaguacuccuggaaguccugggggaaggccaagaucaugggcgccgacguccagaacacgaccuucaucaucgacggccccaacaccccggagugccccgacgaccagcgcgcguggaacaucugggagguggaggacuacggguucggcaucuucaccacgaacaucuggcugaagcuccgggacuccuacacccaggugugcgaccaccgccugaugagcgccgccaucaaggacuccaaggccguccacgccgacaugggguacuggaucgagagcgagaagaacgagaccuggaagcuggcgcgggccuccuucaucgaggugaagaccugcaucuggcccaagagccacacgcucugguccaacggcgugcuggagagcgagaugaucauccccaagaucuacggcgggccgaucucccagcacaacuaccgccccggcuacuucacccagaccgccgggcccuggcaccugggcaagcucgagcuggacuucgaccugugcgaggggaccacggucgugguggacgagcacugcggcaaccggggcccgagccuccgcaccaccaccgucacggggaagaucauccacgaguggugcugccgguccugcacccugccgccccugcgcuuccggggcgaggacgggugcugguacggcauggagauccgccccgugaaggagaaggaggagaaccucgucaagagcauggucagcgccggguccggcgagguggacagcuucucccugggccugcucugcaucagcaucaugaucgaggaggugaugcggucccgcuggagccggaagaugcugaugaccgggacccuggccgucuuccuccugcugaucaugggccagcucacguggaacgaccugauccgccugugcaucauggugggggcgaacgccuccgaccgcaugggcauggggaccaccuaccucgcccugauggccaccuucaagaugcggccgauguucgccguggggcuccuguuccgccggcugacgagccgcgagguccugcuccugaccaucggccugucccucguggcgagcgucgagcugcccaacucccuggaggagcucggggacggccuggccauggggaucaugauccugaagcuccugaccgacuuccagagccaccagcugugggccacccuccugucccugacguucaucaagaccaccuucagccuccacuacgccuggaagaccauggcgauggugcuguccaucgugagccuguucccccucugccuguccacgaccagccagaagaccaccuggcugcccguccuccugggcucccugggcugcaagccgcucacgauguuccugaucgccgagaacaagaucugggggcggcgcagcuggccccugaacgagggcaucauggccguggggaucgugagcauccuccuguccagccugcucaagaacgacgucccccuggccggcccccugaucgccgggggcaugcucaucgcgugcuacgugaucuccggcagcuccgccgaccugagccuggagaaggccgccgagguguccugggaggaggaggccgagcacagcggggcgucccacaacauccucgucgaggugcaggacgacggcaccaugaagaucaaggacgaggagcgggacgacacccugaccauccugcucaaggccacccugcuggccgugagcggggucuacccgcucuccauccccgccacgcuguucgugugguacuucuggcagaagaagaagcagcgcagcggcgugcugugggacacccccagcccgcccgaggucgagcgggccgugcuggacgacgggaucuaccgcaucaugcagcggggccuccugggccgcagccaggugggggucggcguguuccaggagaacguguuccacaccauguggcacgucacccgcggggcggugcugauguaccagggcaagcgccucgagcccuccugggccagcgugaagaaggaccugaucuccuacgggggcggcuggcggcugcaggggagcuggaacacgggcgaggagguccaggugaucgccguggagcccgggaagaaccccaagaacguccagaccgcccccggcaccuucaagacccccgagggggaggugggcgccaucgcgcucgacuucaagcccggcacguccgggagccccaucgugaaccgcgagggcaagaucgucgggcuguacggcaacggcguggugaccaccagcgggaccuacgucuccgccaucgcccaggccaaggcgagccaggagggcccgcugcccgagaucgaggacgagguguuccggaagcgcaaccucacgaucauggaccugcaccccggguccggcaagacccggcgcuaccugccggccaucgugcgggaggccaucaagcgcaagcuccgcacccugauccuggcccccacccgggucguggccagcgagauggcggaggcccucaaggggaugcccauccgcuaccagacgaccgccgugaaguccgagcacaccggcaaggagaucgucgaccugaugugccacgccaccuucacgaugcggcugcucagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggcuacgaguggaucaccgacuuccccgggaagaccgucugguucgugcccagcaucaaguccggcaacgacaucgccaacugccugcggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccucaagcccgucauccugaaggacggccccgagcgcgugauccuggccgggcccaugccggucacgguggccagcgccgcgcagcggcgcggccggaucgggcgcaaccacaacaaggagggcgaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgccgcgaucgacggcgaguaccggcugcgcggggaggcccggaagaccuucguggagcugaugcgccggggcgaccuccccgucuggcugagcuacaagguggccagcgagggguuccaguacuccgaccgccgguggugcuucgacggcgagcgcaacaaccaggugcuggaggagaacauggacgucgagaucuggacgaaggagggcgagcggaagaagcuccgcccccgguggcuggacgcccgcaccuacagcgacccccuggcccuccgggaguucaaggaguucgcggccgggcgccgguccgugagcggcgaccugauccuggagaucgggaagcucccgcagcaccugacccagcgcgcccagaacgcccuggacaaccucgugaugcugcacaacuccgagcagggcggccgggcguaccgccacgccauggaggagcugcccgacaccaucgagacgcucaugcugcuggcccucaucgccguccugaccgggggcgugacccuguucuuccucagcgggcggggccuggggaagaccuccaucggccugcucugcgugauggccagcuccguccugcuguggauggcgagcguggagccccacuggaucgccgccuccaucauccucgaguucuuccugauggugcugcucauccccgagccggaccgccagcggacgccccaggacaaccagcuggccuacgucgugaucggccuccucuucaugauccugacgguggccgcgaacgagauggggcugcucgagaccaccaagaaggaccugggcaucgggcacgccgccgucggcaaccaccaccacgccgccaugcuggacguggaccuccaccccgcgagcgccuggacccuguacgccguggccacgaccaucaucaccccgaugaugcgccacaccaucgagaacacgaccgccaacaucucccugaccgcgaucgccaaccaggccgccauccucauggggcuggacaagggcuggcccaucagcaagauggacaucggcgucccccugcucgcgcuggggugcuacucccaggugaacccccugacccucacggccgccgugcugaugcuggucgcccacuacgccaucaucggcccggggcuccaggcgaaggccacccgcgaggcccagaagcggaccgccgccggcaucaugaagaaccccaccguggacgggaucguggcgaucgaccuggaccccgucguguacgacgccaaguucgagaagcagcugggccagaucaugcuccugauccugugcacgagccagauccuccugaugcgcaccaccugggcccugugcgaguccaucacccucgccacgggcccccugaccacccugugggaggggagcccgggcaaguucuggaacaccacgaucgccguguccauggcgaacaucuuccgggggagcuaccucgccggcgccggccuggccuucagccugaugaagucccucgggggcgggcgccggggcaccggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagacgaccaagcacgccgugagccgcggcaccgccaagcugcggugguucguggagcgcaaccuggucaagcccgaggggaaggugaucgaccucggcugcggccgcggcgggugguccuacuacugcgccgggcugaagaaggugaccgaggucaagggguacacgaagggcgggcccggccacgaggagcccaucccgauggcgaccuacggguggaaccuggugaagcuccacagcggcaaggacguguucuucaucccgcccgagaagugcgacacccugcugugcgacaucggggaguccagccccaacccgaccaucgaggagggccgcacgcuccggguccugaagaugguggagcccuggcugcgcgggaaccaguucugcaucaagauccucaaccccuacaugcccuccguggucgagacccuggagcagaugcagcggaagcacggcggcaugcuggugcgcaacccgcucagccggaacuccacccacgagauguacugggugagcugcgggaccggcaacaucgucuccgccgugaacaugaccagccgcaugcugcugaaccgcuucacgauggcccaccggaagcccaccuacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagacgugggccuaccacgggagcuacgaggucaagccguccggcagcgccagcuccauggugaacggggucgugaagcugcucaccaagcccugggacgugauccccauggucacccagaucgccaugaccgacacgacccccuucggccagcagcggguguucaaggagaagguggacacccgcaccccgaaggccaagcgggggacggcgcagaucauggaggucaccgccaaguggcuguggggcuuccugagccgcaacaagaagccccggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucaccgaggacgaccugcagaacgaggcgcgcaucacggacaucauggagccggagcacgcccugcucgccaagagcaucuucaagcugaccuaccagaacaaggugguccgcgugcagcggcccgccaagaacgggaccgugauggacgucaucucccgccgggaccagcgcggcagcggccaggugggcaccuacggccugaacacguucaccaacauggaggcccagcucauccggcagauggaguccgaggggaucuucagccccuccgagcuggagacccccaaccuggcggagcgcgugcucgacuggcuggagaaguacggcgucgagcggcugaagcgcauggccaucagcggggacgacugcguggugaagccgaucgacgaccgguucgccaccgcccucacggcccugaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcucgugggccgggcgcgcgugagccagggggccggcuggucccugcgggagaccgccugccugggcaagagcuacgcccagauguggcagcucauguacuuccaccgccgggaccugcgccuggcggccaacgccaucugcuccgccguccccguggacuggauccccaccagccggaccacgugguccauccacgcccaccaccaguggaugaccaccgaggacaugcucagcguguggaaccgcgucuggaucgaggagaaccccuggauggaggacaagacccacaucuccagcuggggcgacgugccguaccuggggaagcgcgaggaccaguggugcggcucccugaucggccucacggcgcgggccaccugggccaccaacauccagguggccaucaaccagguccgccggcugaucgggaacgagaacuaccuggacuacaugaccagcaugaagcgcuucaagaacgaguccgaccccgagggcgcccucugguga

SEQ ID NO: 8621 - RNA, 9879 nt, Artificial Sequence
  derived and/or modified CDS sequence (opt1) from DENV-1__GU131710__SS-prME
agcgugaccaugcugcucaugcugaugcccaccgcccuggccuuccaccucaccacccggggcggggagccccacaugaucgcgagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcggguggagacgugggcccuccggcaccccggguucaccgucaucgcccuguuccuggcgcacgccaucggcaccagcaucacccagaaggggaucaucuucauccuccugaugcuggugacgcccuccauggccaugcggugcgugggcaucggcagccgcgacuucgucgaggggcucuccggcgccaccuggguggacgugguccuggagcacgggagcugcgugaccaccauggccaaggacaagcccacgcuggacaucgagcuccugaagaccgaggugaccaaccccgcgguccugcggaagcucugcaucgaggccaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgcgaccaucacgccccaggcccccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgcgaagaagcaggagguggucgugcucggcagccaggagggcgccaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgcggagacccagcacggcaccgugcuggugcagaucaaguacgagggcaccgacgcccccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucaucacgcuguaccugggcgugaugguccaggccgacuccgggugcgugaucaacuggaagggccgggagcucaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucacgguggucgugggggacguggcgggcauccucgcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcugcgggacagcuacacccaggugugcgaccaccgccucauguccgccgccaucaaggacagcaaggccguccacgccgacaugggcuacuggaucgaguccgagaagaacgagaccuggaagcuggcgcgggccagcuucaucgaggugaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuuccgcggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggcgcaugcucaugaccggcacccuggcggucuucuuccugcucaucauggggcagcugacguggaacgaccugauccgccucugcaucauggugggcgccaacgccagcgaccggauggggaugggcaccaccuaccuggcccugauggccaccuucaagaugcgcccgauguucgcggugggccuccuguuccggcgccugacgucccgggagguccuccugcugaccaucgggcucagccugguggccuccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgcguggaagaccauggccaugguccugagcaucgugucccucuucccccugugccugagcacgaccucccagaagaccaccuggcuccccguccugcugggcagccucgggugcaagccgcugacgauguuccugaucgccgagaacaagaucuggggccgccgguccuggccccucaacgaggggaucauggccgugggcaucgugagcauccugcugagcucccuccugaagaacgacgucccccuggccgggccccucaucgcgggcggcaugcugaucgccugcuacgugaucagcggguccagcgccgaccugucccucgagaaggccgccgaggugagcugggaggaggaggcggagcacuccggcgccagccacaacauccuggucgaggugcaggacgacgggaccaugaagaucaaggacgaggagcgcgacgacacccugaccauccuccugaaggccacccugcucgccguguccggcgucuacccgcugagcauccccgccacgcuguucgugugguacuucuggcagcggaagaagcagcgcuccggggugcucugggacacccccagcccgcccgaggucgagcgggcggugcuggacgacggcaucuaccgcaucaugcagcggggccugcuggggcgcucccaggugggcgucgggguguuccaggagaacguguuccacaccauguggcacgucacccggggcgccgugcucauguaccaggggaagcgccuggagcccagcugggccuccgugaagaaggaccugaucagcuacggcggcggguggcggcuccagggcuccuggaacacgggggaggagguccaggugaucgccguggagcccggcaagaaccccaagaacguccagaccgcccccgggaccuucaagacccccgagggcgaggugggcgcgaucgcccuggacuucaagcccgggacgagcggcucccccaucgugaaccgcgaggggaagaucgucggccuguacggcaacgggguggugaccaccagcggcaccuacgucagcgccaucgcccaggcgaaggccucccaggaggggccgcuccccgagaucgaggacgagguguuccggaagcgcaaccugacgaucauggaccugcaccccggcagcgggaagacccggcgcuaccucccggccaucgugcgcgaggccaucaagcggaagcugcgcacccugauccucgcccccacccgggucguggcguccgagauggccgaggcccugaagggcaugcccauccgcuaccagacgaccgccgucaagagcgagcacaccggcaaggagaucgucgaccugaugugccacgccaccuucacgaugcggcuccugucccccgugcgcgugccgaacuacaacaugaucaucauggacgaggcgcacuucaccgaccccagcuccaucgccgcccggggguacaucagcacccgcgucggcaugggggaggccgccgcgaucuucaugaccgccacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgcgaacugccugcggaagaacgggaagcgcgugauccagcucucccggaagaccuucgacacggaguaccagaagaccaagaacaacgacugggacuacgucgugaccaccgacaucagcgagaugggcgccaacuuccgcgccgaccgggugaucgacccgcgccggugccugaagcccgucauccugaaggacgggcccgagcgcgugauccucgccggccccaugccggugacggucgccuccgcggcccagcggcgcgggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccggcugcgcggcgaggcccggaagaccuucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacuccgacccccucgcgcugcgggaguucaaggaguucgccgccggccgccggagcguguccggggaccugauccucgagaucggcaagcugccgcagcaccugacccagcgcgcccagaacgcgcucgacaaccuggugaugcugcacaacagcgagcagggcgggcgggccuaccgccacgccauggaggagcuccccgacaccaucgagacgcugaugcugcucgcccugaucgccguccugaccggcggggugacccucuucuuccuguccggccgggggcugggcaagaccagcaucggccuccugugcgugauggcguccagcguccugcucuggauggccuccguggagccccacuggaucgccgccagcaucauccuggaguucuuccugauggugcuccugauccccgagccggaccgccagcgcacgccccaggacaaccagcuggccuacgucgugaucgggcuccuguucaugauccugacgguggcggccaacgagaugggccuccuggagaccaccaagaaggaccuggggaucggccacgucgccguggagaaccaccaccacgccgccaugcucgacguggaccugcaccccgcguccgccuggacccuguacgccgucgccacgaccaucaucaccccgaugaugcggcacaccaucgagaacacgaccgccaacaucagccucaccgcgaucgccaaccaggccgccauccugauggggcuggacaagggcuggcccaucuccaagauggacaucggcgugccccuccuggcgcuggggugcuacagccaggugaacccccucacccugacggccgccguccugaugcucguggcccacuacgccaucaucggcccggggcugcaggcgaaggccacccgcgaggcccagaagcggaccgccgccggcaucaugaagaaccccaccguggacgggaucgucgcgaucgaccuggaccccgugguguacgacgccaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgucagcauggcgaacaucuuccggggguccuaccuggccggcgccggccuggccuucagccucaugaagucccucgggggcgggcgccgggggaccggggcgcagggcgagacccugggcgagaaguggaagcgccagcucaaccagcuguccaagagcgaguucaacaccuacaagcgguccgggaucauggagguggaccgcagcgaggccaaggagggccugaagcgcggggagacgaccaagcacgccgugucccgcggcaccgccaagcuccggugguucgucgagcgcaaccuggugaagcccgaggggaaggugaucgaccugggcugcggccgcgggggcuggagcuacuacugcgccgggcugaagaaggucaccgaggugaagggcuacacgaagggcggccccggccacgaggagcccaucccgauggcgaccuacggguggaaccucgugaagcugcacuccggcaaggacgucuucuucaucccgcccgagaagugcgacacccugcucugcgacaucggggagagcucccccaacccgaccaucgaggagggccgcacgcugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccgcaacagcacccacgagauguacugggucuccugcgggaccggcaacaucgugagcgccgugaacaugaccucccggaugcugcucaaccgcuucacgauggcccaccggaagcccaccuacgagcgcgacgucgaccugggggccggcacccggcacguggccguggagcccgaggucgcgaaccuggacaucaucggccagcgcaucgagaacaucaagcacgagcacaagagcaccuggcacuacgacgaggacaaccccuacaagacgugggccuaccacggguccuacgaggugaagccgagcggcuccgccagcagcauggugaacggggucgugaagcuccugaccaagcccugggacgucauccccauggugacccagaucgccaugaccgacacgacccccuucggccagcagcggguguucaaggagaaggucgacacccgcaccccgaaggccaagcgggggacggcgcagaucauggaggugaccgccaaguggcuguggggcuuccucucccgcaacaagaagccccggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccgcaucaccgaggacgaccugcagaacgaggcgcggaucacggacaucauggagccggagcacgcccuccuggccaaguccaucuucaagcugaccuaccagaacaaggucgugcgcgugcagcggcccgccaagaacgggaccgucauggacgugaucagccgccgggaccagcgcggcuccggccagguggggaccuacggccucaacacguucaccaacauggaggcccagcugauccggcagauggagagcgaggggaucuucucccccagcgagcuggagacccccaaccucgcggagcgcguccuggacuggcuggagaaguacggcguggagcggcucaagcgcauggccaucuccggggacgacugcguggucaagccgaucgacgaccgguucgccaccgcccugacggcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcgcgcgucagccagggggccggcuggagccugcgggagaccgccugccucgggaaguccuacgcccagauguggcagcugauguacuuccaccgccgggaccugcgccucgcggccaacgccaucugcagcgccgugcccguggacuggauccccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugccguaccuggggaagcgcgaggaccaguggugcggcagccucaucggccugacggcgcgggccaccugggccaccaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8622 - RNA, 9879 nt, Artificial Sequence
  derived and/or modified CDS sequence (opt1) from DENV-1__GU131717__SS-prME
agcgugaccaugcugcucaugcugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaugacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaagacccugaagcuguccugguucaagaaggggagcuccaucggcaagauguucgaggccaccgcccgcggggcccggcgcauggccauccucggcgacacggcgugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggccgacuccccgaagcgccucagcgcggccaucggcaaggccugggaggagggggucugcggcauccgguccgccacccgccuggagaacaucauguggaagcagaucagcaacgagcugaaccacauccuccuggagaacgacaugaaguucaccgugguggucggggacguggccggcauccuggcgcaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacuccuacacccaggugugcgaccaccgccugaugagcgcggccaucaaggacuccaaggccgugcacgccgacaugggcuacuggaucgagagcgagaagaacgagaccuggaagcucgcccgggcguccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccaccuucagccuccacuacgccuggaagaccauggccaugguccuguccaucgugagccuguucccccucugccuguccacgaccagccagaagaccaccuggcugcccgugcuccugggcucccuggggugcaagccgcucacgauguuccugaucgcggagaacaagaucuggggccgcaagagcuggccccugaacgaggggaucauggccgucggcaucgugagcauccuccuguccgcccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugaccauccugcucaaggccacccugcuggccguguccggcguguacccgcucagcauccccgccacgcuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacccggggcgcgguccugaugcaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagaccagcgagggcgaggucggcgccaucgcgcucgacuucaagcccgggacguccggcagccccaucgugaaccgcgaggggaagaucgugggccuguacggcaacggggucgugaccaccagcggcaccuacguguccgccaucgcccaggccaaggcgagccaggaggggccccugccggagaucgaggacgaggucuuccggaagcgcaaccucacgaucauggaccugcaccccggcuccgggaagacccggcgcuaccugcccgccaucgugcgggaggccaucaagcgcaagcuccggacccugauccuggccccgacccgcguggucgccagcgagauggcggaggcccucaagggcaugcccauccgcuaccagacgaccgccgugaaguccgagcacaccggcaaggagaucguggaccugaugugccacgccaccuucacgaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugaccgcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagaccuucgacacggaguaccagaagaccaagaacaacgacugggacuacguggucaccaccgacaucuccgagaugggcgcgaacuuccgcgccgaccgggugaucgacccccgccggugccucaagccggugauccugaaggacgggcccgagcgcgucauccuggccggccccaugcccgugacggucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggacgaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacaccaucgagacgcucaugcugcuggcccucaucgccgugcugaccggcggggucacccuguucuuccucagcggccgggggcugggcaagaccuccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccagcgcguggacccuguacgccguggccacgaccaucaucacccccaugaugcgccacaccaucgagaacacgaccgccaacaucucccugaccgccaucgcgaaccaggccgccauccucauggggcuggacaagggcuggccgaucagcaagauggacaucggcgucccccugcucgcccuggggugcuacucccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgccguguccauggccaacaucuuccgggggagcuaccucgcgggcgccggccuggccuucagccugaugaagucccucgggggcgggcgccggggcaccggggcccagggcgagacccugggcgagaaguggaagcgccagcugaaccagcucagcaaguccgaguucaacaccuacaagcggagcgggaucauggaggucgaccgcuccgaggcgaaggagggccugaagcgcggggagacgaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacacgaagggcgggcccggccacgaggagcccauccccauggccaccuacggguggaaccuggugaagcuccacagcggcaaggacguguucuucaucccgcccgagaagugcgacacccugcugugcgacaucggggaguccagccccaaccccaccaucgaggagggccgcacgcuccggguccugaagaugguggagccguggcugcgcgggaaccaguucugcaucaagauccucaaccccuacaugcccuccguggucgagacccuggagcagaugcagcggaagcacggcggcaugcuggugcgcaacccccucagccggaacuccacccacgagauguacugggugagcugcgggaccggcaacaucgucuccgcggugaacaugaccagccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaaguccaccuggcacuacgacgaggacaaccccuacaagacgugggcguaccacgggagcuacgaggucaagcccuccggcagcgccagcuccauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugagccgcaacaagaagccgcggaucugcacccgcgaggaguucacccggaaggugcgcuccaacgccgccaucggcgccguguucgucgacgagaaccaguggaacagcgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucaccgaggacgaccugcagaacgaggccaagaucacggacaucauggagcccgagcacgcgcugcucgccaagagcaucuucaagcugaccuaccagaacaaggugguccgcgugcagcggccggccaagaacgggaccgugauggacgucaucucccgccgcgaccagcggggcagcggccaggugggcaccuacggccugaacacguucaccaacauggaggcccagcucauccgccagauggaguccgaggggaucuucagccccuccgagcuggagacccccaaccuggccggccgggugcucgacuggcuggagaagcacggggucgagcgccugaagcggauggcgaucagcggcgacgacugcguggugaagcccaucgacgaccgcuucgccgccgcccucaccgcccugaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcucguggggcgcgcgcgggugagccagggcgccggguggucccugcgcgagacggccugccugggcaagagcuacgcccagauguggcagcucauguacuuccaccggcgcgaccugcggcuggcggccaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcggcucccugaucgggcucaccgcgcgggccacgugggccaccaacauccaggucgccaucaaccaggugcgccgccugaucggcaacgagaacuaccuggacuacaugaccagcaugaagcgguucaagaacgaguccgacccggagggggcccucugguga

SEQ ID NO: 8623 - RNA, 9879 nt, Artificial Sequence
  derived and/or modified CDS sequence (opt1) from DENV-1__GU131718__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaucgagcacggcaccaccgcgaccaucacgccccaggcccccacguccgagauccagcucaccgacuacggggcccugacccuggacugcagcccccgcaccggccucgacuucaacgagauggugcugcugacgaugaaggagaaguccuggcucguccacaagcagugguuccuggaccugccgcuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaucgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucaccagcaucgggaagcuggugcaccagaucuucggcacggccuacgggguccucuucuccggcgugagcuggaccaugaagaucgggaucggcgugcugcugaccuggcucggccugaacucccgcagcaccucccugagcaugacgugcaucgccgucgggcucgugacccuguaccugggcgugaugguccaggccgacuccgggugcgugaucaacuggaagggccgggagcucaagugcgggagcggcaucuucgugaccaacgagguccacaccuggacggagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagaugcgggacagcuacacccaggucugcgaccaccgccugauguccgcggccaucaaggacagcaaggccgugcacgccgacaugggcuacuggaucgaguccgagaagaacgagacguggaagcucgcccgggcgagcuucaucgaggugaagaccugcaucuggcccaagucccacacccuguggagcaacggcguccuggaguccgagaugaucauccccaagaucuacgggggcccgaucagccagcacaacuaccgccccggguacuucacccagacggccggccccuggcaccucgggaagcuggagcuggacuucgaccucugcgagggcaccaccgugguggucgacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugacgggcacccucgccguguuccugcugcucaucauggggcagcugaccuggaacgaccugauccggcucugcaucauggugggcgccaacgcgagcgaccgcauggggaugggcaccacguaccuggcccugauggccaccuucaagaugcgcccgauguucgccgucgggcuccuguuccggcgccugaccucccgggaggugcuccugcugaccaucgggcucagccugguggccuccgucgagcugcccaacagccucgaggagcugggcgacgggcuggcgaugggcaucaugauccucaagcugcugacggacuuccagucccaccagcucugggccacccugcugagccucaccuucaucaagaccacgcugucccugcacuacgccuggaagaccauggccauggugcucagcaucgucucccugaucccccugugccucagcaccaccucccagaagacgaccuggcugcccgugcugcucggcagccuggggugcaagccgcugaccauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacgcucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacacgauguggcacgugacccggggcgccguccugauguaccaggggaagcgccuggagcccagcugggcguccgugaagaaggaccucaucagcuacggcggcggguggcggcugcagggcuccuggaacaccggggaggaggugcaggucaucgccguggagcccggcaagaaccccaagaacgugcagaccgcccccgggacguucaagacccccgagggcgaggucggcgccaucgcccuggacuucaagcccgggaccagcggcucccccaucgugaaccgcgaggggaagaucgugggccucuacggcaacggggucgugaccacgagcggcaccuacgugagcgcgaucgcccaggccaaggccucccaggaggggccgcugcccgagaucgaggacgaggucuuccggaagcgcaaccugaccaucauggaccuccaccccggcagcgggaagacccggcgcuaccugccggcgaucgugcgggaggccaucaagcgcaagcugcggacgcucauccuggcccccacccgcguggucgccuccgagauggccgaggcgcugaagggcaugcccauccgcuaccagaccaccgccgucaagagcgagcacacgggcaaggagaucguggaccucaugugccacgccaccuucaccaugcggcugcugucccccguccgcgugccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagacggugugguucguccccuccaucaagagcggcaacgacaucgccaacugccuccggaagaacgggaagcgcgugauccagcugucccggaagaccuucgacaccgaguaccagaagaccaagaacaacgacugggacuacguggucacgaccgacaucagcgagaugggcgccaacuuccgcgcggaccgggugaucgacccgcgccggugccugaagcccgugauccucaaggacgggcccgagcgcgucauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacgcagcgcgcccagaacgcccuggacaaccuggugaugcuccacaacagcgagcagggcgggcgggccuaccgccacgcgauggaggagcugcccgacaccaucgagacccugaugcuccuggcccugaucgccgugcucaccggcggggucacgcuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccacgaagaaggaccucgggaucggccacguggcggucgagaaccaccaccacgccaccaugcuggacguggaccugcaccccgccuccgccuggacccucuacgccguggcgaccacgaucaucaccccgaugaugcgccacaccaucgagaacaccacggccaacaucagccugaccgccaucgccaaccaggccgcgauccugauggggcucgacaagggcuggcccaucuccaagauggacaucggcgucccccugcuggcccucgggugcuacagccaggugaacccccugacccugaccgccgccgugcucaugcuggucgcgcacuacgccaucaucggcccggggcugcaggccaaggccacgcgggaggcccagaagcgcaccgcggccggcaucaugaagaaccccaccguggacgggaucguggccaucgaccucgaccccgucguguacgacgccaaguucgagaagcagcugggccagaucaugcugcucauccugugcaccucccagauccugcucaugcgcacgaccugggcccugugcgagagcaucacccuggcgaccggcccccucacgacccugugggagggguccccgggcaaguucuggaacaccaccaucgccgugagcauggccaacaucuuccggggguccuaccuggccggcgccggccucgcguucagccugaugaagucccucgggggcgggcgccgggggacgggggcccagggcgagacccucggcgagaaguggaagcgccagcugaaccagcuguccaagagcgaguucaacaucuacaagcgguccgggaucauggaggucgaccgcagcgaggccaaggagggccucaagcgcggggagaccacccgccacgccgugucccggggcacggcgaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccaccuacggguggaaccuggugaagcugcacuccggcaaggacguguucuucacgccgcccgagaagugcgacacccuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacgcucgagcagaugcagcgcaagcacggcggcaugcuggugcggaacccgcugucccgcaacagcacccacgagauguacuggguguccugcgggaccggcaacaucgucagcgccgugaacaugaccucccggaugcuccugaaccgcuucaccauggcccaccgcaagcccacguacgagaaggacguggaccugggggcgggcacccggcacgucgccguggagcccgagguggccaaccucgacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcugacgaagcccugggacgugauccccauggucacccagaucgcgaugaccgacaccacgcccuucggccagcagcggguguucaaggagaagguggacacccgcaccccgaaggccaagcgggggaccguccagaucauggaggugacggcccgcuggcucuggggcuuccugucccggaacaagaagccccgcaucugcacccgggaggaguucacccgcaaggugcggagcaacgccgccaucggcgcggucuucguggacgagaaccaguggaacuccgccaaggaggccguggaggacgagcgcuucugggaccuggucaagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggcgggcugggacacccggaucaccgaggacgaccuccagaacgaggccaagaucaccgacaucauggagccggagcacgcccugcuggccacguccaucuucaagcucaccuaccagaacaaggucgugcgcgugcagcggcccgccaagaacgggaccgucauggacgugaucagccgccgcgaccagcggggcuccggccaggugggcaccuacggccugaacacguucaccaacauggaggcgcagcugauccgccagauggagagcgaggggaucuuccuccccuccgagcuggagacccccaaccuggccgagcggguccucgacuggcuggagaaguacggcguggagcgccugaagcggauggccaucagcggggacgacugcguggucaagccgaucgacgaccgcuucgccaccgcccucacggcgcugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcccgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccaccagccgcaccacgugguccauccacgcgcaccaccaguggaugaccaccgaggacaugcucagcguguggaaccggguguggaucgaggagaaccccuggauggaggacaagacccacgucuccagcuggggcgacgugccguaccuggggaagcgcgaggaccaguggugcggcucccugaucggccucacggcccgggccaccugggccagcaacauccagguggccaucaaccagguccgccgccugaucgggaacgagaacuaccuggacuacaugaccuccaugaagcgguucaagaacgagggcgaccccgagggggcgcucugguga

SEQ ID NO: 8624 - RNA, 9879 nt, Artificial Sequence
  derived and/or modified CDS sequence (opt1) from DENV-1__GU131720__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacgcucaucgccauggaccugggcgagcugugcgaggacaccaugaccuacaagugcccccggaucaccgaggccgagcccgacgacguggacugcuggugcaacgccacggacaccugggucaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucgcgaccaacaucuggcugaagcugcgggacagcuacacccaggugugcgaccaccgccucauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgcgaacgccagcgaccgcauggggaugggcacgaccuaccuggcccucauggccaccuucaagaugcgcccgauguucgccgugggccugcuguuccggcgccucaccucccgggagguccugcugcucacgaucgggcugagccugguggcguccgucgagcuccccaacagccuggaggagcugggcgacgggcucgccaugggcaucaugauccugaagcugcucaccgacuuccagucccaccagcugugggccacccugcucagccugaccuucaucaagacgacccugucccuccacuacgccuggaagaccauggcgauggugcugagcaucgugucccuguucccccucugccugagcaccacgucccagaagaccaccuggcugcccguccuccugggcagcuucgggugcaagccgcugaccauguuccucaucacggagaacaagaucuggggccgcaaguccuggccccugaacgaggggaucauggccgugggcguggucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgccgugcugauguaccaggggaagcgccuggagcccagcugggcguccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcccuggacuucaagcccgggacgagcggcucccccaucgucaaccgcgaggggaagaucgugggccucuacggcaacgggguggucaccaccagcggcaccuacgugagcgcgaucgcccaggccaaggccucccaggaggggccgcugcccgagaucgaggacgagguguuccggaagcgcaaccugacgaucauggaccuccaccccggcagcgggaagacccggcgcuaccugccggcgaucguccgggaggccaucaagcgcaagcugcggacccucauccuggcccccacccgcgugguggccuccgagauggccgaggcgcugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgccaacuuccgcgcggaccgggucaucgacccgcgccggugccugaagcccgugauccucaaggacgggcccgagcgcgucauccuggccggccccaugccggugacgguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucacggucgccgccaacgagaugggccugcuggagaccaccaagaaggaccucgggaucggccacguggcgguggagaaccaccaccacgccaccaugcuggacgucgaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggucaacccccugacgcugaccgccgccgugcucaugcugguggcgcacuacgccaucaucggcccggggcugcaggccaaggccacccgggaggcccagaagcgcaccgcggccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacaucuacaagcgguccgggaucauggagguggaccgcagcgaggccaaggagggccucaagcgcggggagacgacccgccacgccgucucccggggcaccgcgaagcugcgcugguucguggagcggaaccuggugaagcccgaggggaaggucaucgaccugggcugcggccgcgggggcuggagcuacuacugcgccgggcucaagaaggugaccgaggugaagggcuacacgaagggcgggcccggccacgaggagcccaucccgauggccaccuacggguggaaccuggucaagcugcacuccggcaaggacguguucuucacgccgcccgagaagugcgacacccuccugugcgacaucggggagagcucccccaacccgacgaucgaggagggccggacccugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggaccggcaacaucgugagcgccgucaacaugacgucccggaugcuccugaaccgcuucaccauggcccaccgcaagcccaccuacgagcgggacguggaccugggggcgggcacccgccacguggccgucgagcccgagguggccaaccucgacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcugcugaccaagcccugggacgugauccccauggugacccagaucgcgaugacggacaccacccccuucggccagcagcgcgucuucaaggagaagguggacacccggacgccgaaggccaagcgcgggaccgcccagaucauggaggugaccgcccgguggcucuggggcuuccugucccgcaacaagaagccccggaucugcacccgcgaggaguucacgcggaagguccgcagcaacgccgcgaucggcgccguguucguggacgagaaccaguggaacuccgccaaggaggccgucgaggacgagcgguucugggaccuggugcagaaggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgagaacagccuguccggggucgagggcgaggggcuccacaagcugggcuacauccugcgggacaucagcaagauccccgggggcaacauguacgcggacgacaccgccggcugggacacccgcaucacggaggacgaccuccagaacgaggccaagaucaccgacaucaugaagccggagcacgcccugcuggccaccuccaucuucaagcucaccuaccagaacaagguggugcggguccagcgccccgcgaagaacgggacggugauggacgugaucagccgccgggaccagcgcggcuccgggcaggucggcaccuacggccugaacaccuucaccaacauggaggcccagcugauccggcagauggagagcgaggggaucuuccuccccuccgagcuggagacgcccaaccuggccgagcgcgugcucgacuggcuggagaaguacggcguggagcggcugaagcgcauggccaucagcggggacgacugcgucgugaagccgaucgacgaccgguucgccaccgcgcucaccgcccugaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcucgucggccgggcccgcgugucccagggggccggcuggagccugcgggagaccgccugccugggcaagagcuacgcgcagauguggcagcucauguacuuccaccgccgggaccugcgccuggccgccaacgccaucugcuccgcggugcccaucgacuggguccccacgagccggaccaccugguccauccacgcccaccaccaguggaugaccacggaggacaugcucagcguguggaaccgcguguggaucgaggagaaccccuggauggaggacaagacccacgucuccagcuggggcgacgugccguaccuggggaagcgggaggaccaguggugcggcucccugaucggccucaccgcccgcgccaccugggccagcaacauccagguggcgaucaaccagguccgccggcugaucgggaacgagaacuaccuggacuacaugaccuccaugaagcgcuucaagaacgagggcgaccccgagggggcccucugguga

SEQ ID NO: 8625 - RNA, 9879 nt, Artificial Sequence
  derived and/or modified CDS sequence (opt1) from DENV-1__HM181960__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggccgggugaucgaccugggcugcgggcgcggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacccacgagauguacuggguguccugcggcaccgggaacaucgucagcgccgugaacaugacgucccgcaugcugcucaaccgguucaccauggcgcaccgcaagcccaccuacgagcgggacguggaccugggcgccggcacccgccacgucgccguggagcccgagguggccaaccuggacaucaucgggcagcggaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcgcguguucaaggagaagguggacacccggacgccgaaggccaagcgcggcaccgcccagaucauggaggucaccgccaaguggcuguggggcuuccucucccggaacaagaagccccgcaucugcacccgggaggaguucacgcgcaaggugcggagcaacgcggccaucggggccguguucgucgacgagaaccaguggaacuccgccaaggaggcgguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcguggagggggagggccugcacaagcucggguacauccugcgggacaucagcaagauccccggcggcaacauguacgccgacgacaccgccgggugggacacccgcaucacggaggacgaccugcagaacgaggcccgcaucaccgacaucauggagccggagcacgcccuccuggcgaaguccaucuucaagcugaccuaccagaacaaggugguccgggugcagcgccccgccaagaacggcaccgugauggacgucaucagccggcgcgaccagcggggguccggccaggugggcacguacgggcucaacaccuucaccaacauggaggcccagcugauccgccagauggagagcgagggcaucuucucccccagcgagcuggagacccccaaccucgccgagcgggugcuggacuggcuggagaaguacggggucgagcgccucaagcggauggccaucuccggcgacgacugcguggugaagccgaucgacgaccgcuucgcgacggcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgcgugccucggcaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgggaggaccaguggugcggcagccucaucgggcugaccgcccgcgccaccugggcgaccaacauccagguggccaucaaccagguccggcgccugaucggcaacgagaacuaccucgacuacaugaccuccaugaagcgguucaagaacgagagcgaccccgagggggcccugugguga

SEQ ID NO: 8626 - RNA, 9879 nt, Artificial Sequence
  derived and/or modified CDS sequence (opt1) from DENV-1__HM181963__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggggaguucugcgaggacaccaugaccuacaagugcccccgcaucaccgaggccgagcccgacgacguggacugcuggugcaacgccaccgacaccugggugaccuacgggaccugcagccagaucggggagcaccggcgcgacaagcgguccguggcccuggcgccccacgugggccucgggcuggagacccgcacggagaccuggaugagcuccgagggcgccuggaagcagauccagcggguggagaccugggcccugcgccaccccggguucaccgugaucgcccucuuccuggcgcacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggccaaggacaagcccacccuggacaucgagcugcucaagaccgaggucacgaaccccgcggugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgccaaguucaagugcgugacgaagcucgagggcaagaucguccaguacgagaaccugaaguacagcgugaucgugaccguccacaccggcgaccagcaccagguggggaacgaguccaccgagcacggcacgaccgcgaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggccgagccgcccuucggggagagcuacaucgugaucggcgugggcgagaaggcgcugaagcuguccugguucaagaaggggagcuccaucggcaagauguucgaggccaccgcccgcggggcccggcgcauggccauccucggcgacaccgcgugggacuucgggagcaucggcggcgucuucaccuccguggggaagcuggugcaccagaucuucggcacggccuacgggguccuguucagcggcguguccuggaccaugaagaucgggaucggcgugcuccugaccuggcugggccucaacagccgcuccaccagccuguccaugacgugcaucgccgucgggcuggugacccucuaccugggcgugaugguccaggccgacagcgggugcgugaucaacuggaagggccgggagcugaagugcgggagcggcaucuucgugaccaacgagguccacaccuggacggagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaagcugaccguggucgugggggacguggccggcauccucgcgcaggggaagaagaugauccggccccagcccauggaguacaaguacuccuggaaguccuggggcaaggccaagaucaucggcgccgacguccagaacaccaccuucaucaucgacgggcccaacacgccggagugccccgacgaccagcgcgccuggaacaucugggagguggaggacuacggcuucgggaucuucaccaccaacaucuggcugaagcugcgggacuccuacacccaggugugcgaccaccgccucaugagcgcggccaucaaggacuccaaggccguccacgccgacaugggcuacuggaucgagagcgagaagaacgagacguggaagcuggcccgggcguccuucaucgaggugaagaccugcaucuggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugacgggcacccuggccgucuucuuccugcucaucauggggcagcugaccuggaacgaccugauccggcucugcaucauggugggcgccaacgcguccgaccgcauggggaugggcaccacguaccuggcccugauggccaccuucaagaugcgcccgauguucgccgugggccuccuguuccggcgccugaccagccgggagguccuccugcugaccaucgggcucucccugguggccagcgucgagcugcccaacucccucgaggagcugggcgacgggcuggcgaugggcaucaugauccucaagcugcugacggacuuccagagccaccagcucugggccacccugcuguccaugaccuucauccgcaccacguucagccuccacuacgccuggaagaccauggccauggugcuguccaucgugagccuguucccccucugccuguccaccaccagccagaagacgaccuggcugcccguccuccugggcucccuggggugcaagccgcucaccauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccguggucuccugggaggaggaggccgagcacagcggcgccucccacaacauccucguggaggugcaggacgacgggaccaugaagaucaaggacgaggagcgcgacgacacgcugaccauccugcucaaggcgacccugcuggccgucagcggcguguacccgcucuccauccccgccacccuguucgugugguacuucuggcagaagaagaagcagcggagcgggguccugugggacacccccagcccgcccgagguggagcgcgccgugcucgacgacggcaucuaccggaucaugcagcgcggccugcuggggcggagccaggucggcguggggguguuccaggagaacgucuuccacacgauguggcacgugacccgcggcgccgugcugauguaccaggggaagcggcucgagcccuccugggcgagcgucaagaaggaccugaucuccuacggcggcggguggcgccugcagggcagcuggaacaccggggaggagguccaggugaucgccgucgagcccggcaagaaccccaagaacgugcagaccgcccccgggacguucaagaccuccgagggcgaggugggcgccaucgcccucgacuucaagcccgggaccagcggcagccccaucgucaaccgggaggggaagguggugggccuguacggcaacggggucgugaccacguccggcaccuacgugagcgcgaucgcccaggccaaggccucccaggaggggccccugccggagaucgaggacgaggucuuccgcaagcggaaccucaccaucauggaccugcaccccggcagcgggaagacccgccgguaccugcccgcgaucgugcgcgaggccaucaagcggaagcuccgcacgcugauccuggccccgacccgcguggucgccuccgagauggccgaggcgcucaagggcaugcccauccgguaccagaccaccgccgucaagagcgagcacacgggcaaggagaucguggaccugaugugccacgccaccuucaccaugcgccugcucucccccguccgggugcccaacuacaacaugaucaucauggacgaggcccacuucaccgacccgagcuccaucgccgcgcgcggguacaucagcacgcgggugggcaugggggaggccgccgccaucuucaugaccgccacgccgcccggcuccgucgaggcguucccccagagcaacgccgugauccaggacgaggagcgcgacaucccggagcgguccuggaacagcggguacgaguggaucaccgacuuccccggcaagacggugugguucguccccuccaucaagagcggcaacgacaucgccaacugccugcgcaagaacgggaagcgggugauccagcugucccgcaagaccuucgacaccgaguaccagaagaccaagaacaacgacugggacuacguggucacgaccgacaucagcgagaugggcgccaacuuccgggcggaccgcgugaucgacccccggcgcugccucaagccggucauccugaaggacgggcccgagcgggugauccuggccggccccaugcccgugaccgucgccuccgccgcccagcgccgggggcgcaucggccggaaccacaacaaggagggcgaccaguacaucuacauggggcagccgcucaacaacgacgaggaccacgcgcacuggaccgaggccaagaugcugcuggacaacaucaacacgcccgagggcaucauccccgcccucuucgagcccgagcgcgagaaguccgccgccaucgacggggaguaccgccugcggggcgaggcgcgcaagaccuucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgccgcgggccggcgcagcgucuccggggaccugauccuggagaucggcaagcucccccagcaccugacgcagcgggcccagaacgcccuggacaaccucgugaugcugcacaacagcgagcagggcgggcgcgccuaccggcacgcgauggaggagcugccggacaccaucgagacccucaugcugcuggcccucaucgccgugcugaccggcggggucacgcuguucuuccucuccggccgcgggcugggcaagaccagcaucggccugcucugcgugauggccuccagcgugcugcuguggauggccuccgucgagccccacuggaucgcggccagcaucauccucgaguucuuccugauggugcugcucauccccgagcccgaccggcagcgcaccccgcaggacaaccagcuggccuacguggucaucgggcuccuguucaugauccugaccguggccgccaacgagaugggccugcucgagaccacgaagaaggaccuggggaucggccacguggcggucgagaaccaccaccacgccgccaugcuggacguggaccuccaccccgccuccgccuggacccuguacgcgguggccaccaccaucaucacgcccaugaugcggcacaccaucgagaacaccaccgccaacaucagccugacggccaucgccaaccaggcggccauccucauggggcuggacaagggcuggccgaucuccaagauggacaucggcgucccccugcucgcccuggggugcuacagccaggugaacccccugacccucaccgccgcggugcugaugcuggucgcccacuacgccaucaucggccccgggcuccaggccaaggccacccgcgaggcgcagaagcgcacggccgccggcaucaugaagaacccgaccguggacgggaucguggccaucgaccuggaccccgucguguacgacgccaaguucgagaagcagcugggccagaucaugcuccugauccugugcaccucccagauccuccugaugcggaccacgugggcgcugugcgagagcaucacccucgccaccggcccccugaccacgcugugggaggggucccccggcaaguucuggaacaccaccaucgccgugagcauggccaacaucuuccgcgggagcuaccucgccggcgcgggccuggccuucucccugaugaagucccucgggggcgggcggcgcggcaccggggcccagggcgagacgcugggcgagaaguggaagcggcagcugaaccagcucuccaagagcgaguucaacaccuacaagcgcuccgggaucauggaggucgaccggagcgaggccaaggagggccugaagcgcggggagaccaccaagcacgcggugucccggggcacggccaagcugcgcugguucguggagcggaaccucgucaagccggaggggaaggugaucgaccugggcugcggccgcgggggcuggagcuacuacugcgccgggcugaagaaggugaccgaggucaagggcuacaccaagggcgggcccggccacgaggagcccauccccauggccaccuacggguggaaccuggugaagcuccacuccggcaaggacguguucuucaucccgcccgagaagugcgacacgcugcugugcgacaucggggagagcucccccaaccccaccaucgaggagggccggacccuccgcguccugaagaugguggagccguggcugcgggggaaccaguucugcaucaagauccucaaccccuacaugcccagcguggucgagacccuggagcagaugcagcgcaagcacggcggcaugcuggugcggaacccccucucccgcaacagcacgcacgagauguacuggguguccugcgggaccggcaacaucgucagcgccgugaacaugaccucccggaugcugcugaaccgcuucaccauggcgcaccgcaagccgaccuacgagcgggacguggaccucggggccggcacgcgccacgucgccguggagcccgaggucgccaaccuggacaucaucggccagcggaucgagaacaucaagcacgagcacaagagcaccuggcacuacgacgaggacaaccccuacaagaccugggccuaccacggguccuacgaggugaagcccagcggcagcgcguccagcauggugaacggggucgugaagcugcucaccaagccgugggacgugauccccauggucacgcagaucgccaugaccgacaccacccccuucggccagcagcgcguguucaaggagaagguggacacgcggacccccaaggccaagcgcgggaccgcccagaucauggaggucaccgccaaguggcuguggggcuuccugucccggaacaagaagccgcgcaucugcacgcgggaggaguucacccgcaaggugcggagcaacgcggccaucggcgccguguucgucgacgagaaccaguggaacuccgccaaggaggcgguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacgcgcaucaccgaggacgaccugcagaacgaggccaagaucaccgacaucauggagcccgagcacgcccugcucgcgaaguccaucuucaagcugaccuaccagaacaaggugguccgggugcagcgcccggccaagaacgggacggugauggacgucaucagccgccgggaccagcgcggcuccggccaggugggcaccuacggccugaacaccuucaccaacauggaggcccagcucauccggcagauggagagcgaggggaucuucucccccagcgagcuggagacgcccaaccuggccggccgcgcccucgacuggcuggagaagcacgggguggagcggcugaagcgcauggcgaucuccggcgacgacugcgucgugaagcccaucgacgaccgguucgccaccgcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcccgcgugucccagggcgcgggguggagccugcgggagaccgccugccugggcaaguccuacgcccagauguggcagcucauguacuuccaccgccgggaccugcgccuggccgcgaacgccaucugcagcgccgugccggucgacugggugcccacgucccggaccaccuggagcauccacgcccaccaccaguggaugaccacggaggacaugcucuccguguggaaccgcgucuggaucgaggagaaccccuggauggaggacaagacccacaucagcuccuggggcgacgugcccuaccugggcaagcgggaggaccaguggugcggcagccugaucgggcucaccgcccgcgcgaccugggccacgaacauccagguggccaucaaccagguccgccggcugcugggcaacgagaacuaccucgacuacaugaccuccaugaagcgcuucaagaacgagagcgacccggagggggcccugugguga

SEQ ID NO: 8627 - RNA, 9879 nt, Artificial Sequence
  derived and/or modified CDS sequence (opt1) from DENV-1__HM181964__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacugcgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcugagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccucaaggacgggcccgagcgggucauccuggccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccggggcgaggcgcgcaagacguucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacuccgacccccuggcccugcgcgaguucaaggaguucgccgcgggccggcgcagcgucuccggggaccucauccuggagaucggcaagcugccgcagcaccucacccagcgggcccagaacgcccuggacaaccuggugaugcuccacaacagcgagcagggcgggcgcgccuaccggcacgcgauggaggagcugcccgacacgaucgagacccugaugcuccuggcccugaucgccgugcucaccggcggggucacccuguucuuccuguccggccgcgggcucggcaagaccagcaucggccugcugugcgugauggccuccagcgugcuccuguggauggccuccgucgagccccacuggaucgcggccagcaucauccuggaguucuuccucauggugcugcugauccccgagccggacaagcagcggacgccccaggacaaccagcucgccuacguggucaucgggcugcuguucaugauccucaccguggccgccaacgagaugggccugcuggagaccaccaagaaggaccucgggaucggccacguggcggucgagaaccaccaccacgccgccaugcuggacguggaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgucccccugcuggcccucgggugcuacagccaggugaacccccugacgcugaccgccgcggugcucaugcuggucgcccacuacgccaucaucggcccggggcugcaggccaaggccacccgcgaggcgcagaagcggaccgccgccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgcggugucccgcggcaccgccaagcugcggugguucguggagcgcaaccuggucaagcccgaggggaaggugaucgaccugggcugcggccgcggcggguggagcuacuacugcgccgggcucaagaaggugacggaggucaagggguacaccaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggugguccgcgugcagcggcccgccaagaacgggaccgugauggacgucaucagccgccgggaccagcgcggcuccggccaggugggcacguacggccugaacaccuucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggccaucuccggggacgacugcguggugaagccgaucgacgaccgguucgcgacggcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8628 - RNA, 9879 nt, Artificial Sequence
  derived and/or modified CDS sequence (opt1) from DENV-1__HM181966__SS-prME
agcgugaccaugcugcucaugcugaugcccaccgcccuggccuuccaccucaccacccggggcggggagccccacaugaucgugaccaagcaggagcgggggaagucccugcuguucaagaccagcgugggggugaacaugugcacgcucaucgccauggaccugggcgagcugugcgaggacaccaugaccuacaagugcccccggaucaccgaggccgagcccgacgacguggacugcuggugcaacgccacggacaccugggugaccuacgggaccugcucccagacgggcgagcaccggcgcgacaagcggagcguggcccucgcgccccacgucggccuggggcuggagacccgcaccgagaccuggauguccagcgagggcgcguggaagcagauccagcggguggagacgugggcccuccgccaccccggguucaccgugaucgcccuguuccuggcccacgcgaucggcaccuccaucacccagaaggggaucaucuucauccuccugaugcuggucacgcccagcauggccaugcggugcgugggcaucggcucccgcgacuucguggaggggcucagcggcgccaccugggucgacguggugcuggagcacggguccugcgucaccaccauggccaaggacaagcccacgcuggacaucgagcuccugaagaccgaggugaccaaccccgccgugcugcggaagcucugcaucgaggcgaagaucagcaacaccacgaccgacucccgcugcccgacccagggcgaggccacccugauggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccuggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcucaagcugagcugguucaagaagggguccagcaucggcaagauguucgaggccaccgcccgcggggcccggcgcauggccauccugggcgacacggcgugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccucgagaacaucauguggaagcagaucuccaacgagcugaaccacauccugcucgagaacgacaugaaguucaccgugguggucggggacguggugggcauccuggcccaggggaagaagaugauccggccccagcccauggagcacaaguacagcuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggugugcgaccaccgccugauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuucaagggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacccuggccgucuuccuccugcugaucauggggcagcucacguggaacgaccugauccggcugugcaucauggugggcgccaacgccagcgaccgcauggggaugggcaccaccuaccucgcgcugaucgccaccuucaagaugcgcccgauguucgccgugggccuccuguuccggcgccugacgucccgggagguccugcuccugaccaucgggcugagccucguggccuccgucgagcugcccaacagccuggaggagcucggcgacgggcuggccaugggcaucaugauccugaagcuccugaccgacuuccagucccaccagcugugggcgacccuccugagcuucacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucgccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccaagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagaccagcgagggcgaggugggcgccaucgcccucgacuucaagcccgggacguccggcagccccaucgucaaccgcgaggggaagaucgugggccuguacggcaacgggguggucaccaccagcggcaccuacguguccgccaucgcgcaggccaaggccagccaggaggggccccugccggagaucgaggacgagguguuccggaagcgcaaccucacgaucauggaccugcaccccggcuccgggaagacccggcgcuaccugcccgccaucguccgggaggcgaucaagcgcaagcuccggacccugauccuggccccgacccgcgugguggccagcgagauggccgaggcccucaagggcaugcccauccgcuaccagacgaccgcggucaaguccgagcacaccggcaaggagaucguggaccugaugugccacgccaccuucacgaugcggcugcucagccccgugcgcguccccaacuacaacaugaucaucauggacgaggcccacuucaccgacccguccagcaucgccgcccggggguacaucuccacccgcgugggcaugggggaggcggccgccaucuucaugaccgccacgccgcccggcagcguggaggccuucccccaguccaacgcggucauccaggacgaggagcgggacaucccggagcgcagcuggaacuccggguacgaguggaucaccgacuuccccggcaagaccgugugguucgugcccagcaucaaguccggcaacgacaucgccaacugccugcggaagaacgggaagcgcgucauccagcugagccggaagaccuucgacacggaguaccagaagaccaagaacaacgacugggacuacguggugaccaccgacaucuccgagaugggcgccaacuuccgcgccgaccgggucaucgacccccgccggugccucaagccggugauccugaaggacgggcccgagcgcgucauccuggcgggccccaugcccgugacgguggccagcgccgcccagcggcgcgggcggaucggccgcaaccacaacaaggagggcgaccaguacaucuacauggggcagccgcucaacaacgacgaggaccacgcccacuggaccgaggcgaagaugcugcuggacaacaucaacacccccgagggcaucauccccgcccucuucgagcccgagcgggagaaguccgccgccaucgacggggaguaccgccugcgcggcgaggcccggaagaccuucgucgagcugaugcgccgcggggaccucccgguguggcugagcuacaagguggcgagcgagggcuuccaguacuccgaccgccgguggugcuucgacggcgagcgcaacaaccagguccuggaggagaacauggacguggagaucuggacgaaggagggggagcggaagaagcuccgcccccgguggcuggacgcccgcaccuacagcgacccccuggcccuccgggaguucaaggaguucgccgccggccgccgguccgugagcggggaccugauccuggagaucggcaagcucccccagcaccugacccagcgcgcgcagaacgcccuggacaaccucgucaugcugcacaacuccgagcagggcgggcgggccuaccgccacgccauggaggagcugccggacaccaucgagacgcucaugcugcuggcgcucaucgccgugcugaccggcggggugacccuguucuuccucagcggccgggggcugggcaagaccuccaucggccugcucugcgucauggccagcuccgcccugcuguggauggccagcguggagccccacuggaucgcggccuccaucauccucgaguucuuccugauggugcugcucauccccgagcccgaccgccagcggaccccgcaggacaaccagcuggccuacgucgugaucgggcuccuguucaugauccugacgguggccgccaacgagaugggccugcucgagaccaccaagaaggaccuggggaucggccacgucgcgguggagaaccaccaccacgccaccaugcuggacguggaccuccaccccgccagcgccuggacgcuguacgccgucgcgaccaccaucaucacccccaugaugcgccacacgaucgagaacaccaccgccaacaucucccugaccgccaucgccaaccaggccgcgauccucauggggcuggacaagggcuggccgaucagcaagauggacaucggcgugccccugcucgcccuggggugcuacucccaggugaacccccugacgcucaccgccgccguccugaugcugguggcgcacuacgccaucaucggccccgggcuccaggccaaggccacccgggaggcccagaagcgcaccgcggccggcaucaugaagaacccgacgguggacgggaucgucgccaucgaccuggaccccgugguguacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagccccggcaaguucuggaacacgaccaucgccgucuccauggccaacaucuuccgggggagcuaccucgccggcgccggccuggcguucagccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgugagccggggcaccgcgaagcugcgcugguucgucgagcggaaccuggugaagccggaggggaaggugaucgaccucggcugcggccgcgggggcugguccuacuacugcgccgggcugaagaaggucaccgaggugaagggcuacacgaagggcgggcccggccacgaggagcccauccccauggccaccuacggguggaaccuggugaagcuccacagcggcaaggacgucuucuucaccccgcccgagaagugcgacacccugcugugcgacaucggggaguccagccccaaccccacgaucgaggagggccggacccuccgcgugcugaagaugguggagccguggcugcgggggaaccaguucugcaucaagauccucaaccccuacaugcccuccgucguggagacccuggagcagaugcagcgcaagcacggcggcaugcuggugcggaacccccucagccgcaacuccacccacgagauguacugggucagcugcgggaccggcaacaucguguccgccgugaacaugacgagccggaugcugcugaaccgcuucaccauggcccaccgcaagccgaccuacgagcgggacgucgaccucggggcgggcacccgccacguggccguggagcccgaggucgccaaccuggacaucaucggccagcggaucgagaacaucaagcacgagcacaaguccacguggcacuacgacgaggacaaccccuacaagaccugggccuaccacgggagcuacgaggugaagcccuccggcagcgccagcuccauggucaacgggguggugaagcugcucaccaagccgugggacgucauccccauggugacccagaucgcgaugacggacaccacccccuucggccagcagcgcguguucaaggagaaggucgacacccggacgcccaaggccaagcgcgggaccgcccagaucauggaggugaccgcccgguggcuguggggcuuccugagccgcaacaagaagccgcggaucugcacccgcgaggaguucacgcggaaggugcgcuccaacgccgcgaucggcgccgucuucguggacgagaaccaguggaacagcgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgcggacgacaccgccggcugggacacccgcaucacggaggacgaccugcagaacgaggccaagaucaccgacaucauggagcccgagcacgcccugcucgccaccagcaucuucaagcugaccuaccagaacaaggucgugcgggugcagcgcccggcgaagaacgggacggucauggacgugaucucccgccgggaccagcgcggcagcggccaggugggcaccuacggccugaacaccuucaccaacauggaggcccagcucauccggcagauggaguccgaggggaucuuccugcccagcgagcuggagacgcccaaccucgccgagcgcguccuggacuggcuggagaaguacggcguggagcggcucaagcgcauggccaucuccggggacgacugcguggucaagcccaucgacgaccgguucgccaccgcgcugaccgcccugaacgacaugggcaaggugcgcaaggacaucccgcagugggagcccagcaagggguggaacgacuggcagcagguccccuucugcucccaccacuuccaccagcucgucaugaaggacggccgggagaucguggugcccugccgcaaccaggacgagcuggucggccgggcccgcgugagccagggggccggcuggagccugcgggagaccgccugccucgggaaguccuacgcgcagauguggcagcugauguacuuccaccgccgggaccugcgccucgccgccaacgccaucugcagcgcggugccggucgacugggugcccacgucccggaccaccuggagcauccacgcccaccaccaguggaugaccacggaggacaugcuguccguguggaaccgcgucuggaucgaggagaaccccuggauggaggacaagacccacgugagcuccuggggcgacgugcccuaccuggggaagcgggaggaccaguggugcggcagccucaucggccugaccgcccgcgccaccugggccuccaacauccaggucgcgaucaaccaggugcgccggcugaucgggaacgagaacuaccucgacuacaugaccagcaugaagcgcuucaagaacgagggcgacccggagggggcccugugguga

SEQ ID NO: 8629 - RNA, 9879 nt, Artificial Sequence
  derived and/or modified CDS sequence (opt1) from DENV-1__GU131721__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccgccgggaagcucgugcaccagaucuucggcaccgccuacgggguccuguucagcggcguguccuggacgaugaagaucgggaucggcgugcugcucaccuggcugggccugaacagccgcuccaccagccucuccaugaccugcaucgccgucgggcuggugacgcuguaccucggcgugaugguccaggccgacagcgggugcgugaucaacuggaagggccgggagcugaagugcggguccggcaucuucgugaccaacgagguccacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucacgguggucgugggggacguggcgggcauccuggcccaggggaagaagaugauccggccccagcccauggaguacaaguacuccuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacuccuacacccaggugugcgaccaccgccugaugagcgccgccaucaaggacuccaaggccguccacgccgacaugggcuacuggaucgagagcgagaagaacgagaccuggaagcuggcgcgggccuccuucaucgaggugaagacgugcaucuggcccaagagccacacccucugguccaacggcgugcuggagagcgagaugaucguccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgcgaacgccuccgaccgcauggggaugggcaccaccuaccuggcccucauggccacguucaagaugcggccgauguucgccgucggccugcuguuccgccggcucaccagccgcgaggugcugcugcucaccaucgggcugucccugguggcgagcgucgagcuccccaacucccuggaggagcugggcgacgggcucgccaugggcaucaugauccugaagcugcucaccgacuuccagagccaccagcugugggccacgcugcucucccugaccuucaucaagaccaccuucagccugcacuacgccuggaagacgauggcgauggugcucuccaucgucagccuguucccccugugccucuccaccaccagccagaagaccacguggcugcccgugcugcucggcucccuggggugcaagccgcugaccauguuccucaucgccgagaacaagaucuggggccggcgcagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagaaggccgccgaggucuccugggaggaggaggccgagcacagcggcgcgucccacaacauccugguggaggugcaggacgacgggaccaugaagaucaaggacgaggagcgggacgacacccucaccauccugcugaaggccacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgcggugcugauguaccaggggaagcgccuggagcccuccugggccagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccuccggcagccccaucgucaaccgcgaggggaagaucgugggccucuacggcaacgggguggucaccaccuccggcacguacgugagcgccaucgcccaggccaaggcgagccaggaggggccgcugcccgagaucgaggacgagguguuccggaagcgcaaccugaccaucauggaccuccaccccggcuccgggaagacccggcgcuaccugccggccaucguccgggaggccaucaagcgcaagcugcgcacccucauccuggcccccacgcgggugguggccagcgagauggcggaggcccugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgcggcccggggguacaucuccacccgcgugggcaugggggaggccgccgccaucuucaugacggcgacgccgcccggcagcguggaggccuucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgcgaacuuccgcgccgaccgggucaucgacccgcgccggugccugaagcccgugauccucaaggacgggcccgagcgcgugauccuggccggccccaugccggucaccguggccagcgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgcggccggccgccgguccgugagcggggaccucauccuggagaucggcaagcugccgcagcaccucacccagcgcgcccagaacgcccuggacaaccuggucaugcuccacaacuccgagcagggcgggcgggcguaccgccacgccauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucgggcugcuguucaugauccucaccgucgccgcgaacgagaugggccugcuggagaccaccaagaaggaccucgggaucggccacguggccguggagaaccaccaccacgccgccaugcuggacgucgaccugcgccccgccagcgcguggacgcucuacgccguggccaccaccaucaucaccccgaugaugcgccacacgaucgagaacaccaccgccaacaucucccugaccgccaucgcgaaccaggccgccauccugauggggcucgacaagggcuggcccaucagcaagauggacaucggcgugccccugcuggcccucgggugcuacucccaggucaacccccugacgcugaccgcggccgugcucaugcugguggcccacuacgccaucaucggcccggggcugcaggccaaggcgacccgggaggcccagaagcgcaccgccgccggcaucaugaagaaccccacggucgacgggaucguggccaucgaccucgaccccguggucuacgacgcgaaguucgagaagcagcugggccagaucaugcugcucauccugugcaccagccagauccugcucaugcggaccaccugggcccugugcgaguccaucacgcuggccaccggcccccucaccacccugugggaggggagcccgggcaaguucuggaacacgaccaucgccguguccauggccaacaucuuccgcgggagcuaccuggcgggcgccggccucgccuucucccugaugaagucccucgggggcgggcggcgcgggaccggggcccagggcgagacccucggcgagaaguggaagcggcagcugaaccagcugagcaaguccgaguucaacacguacaagcgcagcgggaucauggagguggaccgguccgaggcgaaggagggccucaagcgcggggagaccaccaagcacgccgucagccggggcaccgccaagcugcgcugguucguggagcggaaccuggugaagcccgaggggaaggucaucgaccugggcugcggccgcgggggcugguccuacuacugcgccgggcucaagaaggugacggaggugaagggcuacaccaagggcgggcccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccggacccugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgcggucaacaugacgagccgcaugcuccugaaccgguucaccauggcccaccgcaagcccaccuacgagcgggacguggaccugggggccggcacccgccacguggccgucgagcccgagguggccaaccucgacaucaucggccagcggaucgagaacaucaagcacgagcacaaguccacguggcacuacgacgaggacaaccccuacaagaccugggcguaccacgggagcuacgaggugaagccguccggcagcgccuccagcauggucaacgggguggucaagcugcugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgaaguggcucuggggcuuccugagccggaacaagaagccccgcaucugcacccgggaggaguucacgcgcaagguccgguccaacgccgccaucggcgccguguucguggacgagaaccaguggaacagcgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcgcgguuccucgaguucgaggcccugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucacggaggacgaccuccagaacgaggcccgcaucaccgacaucauggagccggagcacgcgcugcuggccaagagcaucuucaagcucaccuaccagaacaagguggugcggguccagcgccccgccaagaacgggaccgugauggacgugaucucccggcgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucgagaaguacggcguggagcgccugaagcggauggcgaucagcggggacgacugcgucgugaagccgaucgacgaccgcuucgccacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugucccagggggcgggcuggagccuccgcgagaccgccugccugggcaagagcuacgcccagauguggcagcugauguacuuccaccggcgcgaccuccggcuggccgcgaacgccaucugcuccgccgugcccgucgacuggauccccaccagccgcacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgggaggaccaguggugcggcucccugaucggccugaccgcccgcgcgaccugggccaccaacauccagguggccaucaaccaggugcggcgccucaucgggaacgagaacuaccuggacuacaugaccagcaugaagcgguucaagaacgagggcgagcccgagggggcccugugguga

SEQ ID NO: 8630 - RNA, 9879 nt, Artificial Sequence
  derived and/or modified CDS sequence (opt1) from DENV-1__GU131723__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucguggggcagcugaccuggaacgaccucauccgccugugcaucauggucggcgccaacgcgagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugguccucagcguggugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcgggugggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccgagcgcgugcuggacuggcucgagaaguacggcguggagcggcugaagcgcauggccaucuccggggacgacugcgucgugaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8631 - RNA, 9879 nt, Artificial Sequence
  derived and/or modified CDS sequence (opt1) from DENV-1__GU131725__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgggacaagcggagcguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucuccgagaugguccugcugaccaugaaggagaaguccuggcucgugcacaagcagugguuccuggaccugccccuccccuggaccagcggggccuccaccagccaggagacguggaaccggcaggaccugcuggugaccuucaagaccgcccacgcgaagaagcaggaggucguggugcucggcucccaggagggcgccaugcacaccgcccugacgggggccaccgagauccagaccagcggcaccacgaccaucuucgccgggcaccugaagugccgccucaagauggacaagcugacccugaagggcauguccuacgucaugugcaccgggagcuucaagcucgagaaggagguggcggagacgcagcacggcaccgugcugguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccgucgggaagcuggugcaccagaucuucggcaccgccuacggggugcuguucagcggcgucuccuggaccaugaagaucgggaucggcgugcugcugacguggcucggccugaacagccgcuccaccagccuguccaugaccugcaucgccguggggcucgucacccuguaccugggcgugauggugcaggccgacagcgggugcgucaucaacuggaagggccgggagcucaagugcgggagcggcaucuucgugacgaacgaggugcacaccuggaccgagcaguacaaguuccaggcggacuccccgaagcgccugagcgccgccaucggcaaggccugggaggagggggucugcggcauccgguccgccacccgccuggagaacaucauguggaagcagaucagcaacgagcucaaccacauccugcuggagaacgacaugaagcucaccgugguggucggggacguggcgggcauccuggggcagggcaagaagaugauccggccccagcccauggaguacaaguacuccuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacuccuacacccaggucugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacgcucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcaccacggugguggucgacgagcacugcgggaaccggggcccgagccuccgcaccaccaccgugacggggaagaucauccacgaguggugcugccgguccugcacccugccgccccugcgcuuccggggcgaggacgggugcugguacggcauggagauccgccccgugaaggagaaggaggagaaccucgucaagagcauggugagcgccggcuccggggagguggacagcuucucccugggccugcucugcaucagcaucaugaucgaggaggucaugcggucccgcuggagccggaagaugcugaugaccgggacccuggccguguucuuccuccugaucaugggccagcugacguggaacgaccucauccgccugugcaucauggugggggcgaacgccuccgaccgcaugggcaugggcaccaccuaccuggcccucauggccaccuucaagaugcggccgauguucgccgucgggcugcuguuccgccggcucacgagccgcgaggugcugcugcucaccaucggccugucccugguggcgagcgucgagcuccccaacucccuggaggagcugggggacggccucgccaugggcaucaugauccugaagcugcucaccgacuuccagagcuaccagcugugggccacccugcucucccugacguucaucaagaccaccuucagccugcacuacgccuggaagaccauggcgauggugcucuccaucgucagccuguucccccugugccucuccacgaccagccagaagaccaccuggcugcccgugcugcucgggucccugggcugcaagccgcugacgauguuccucaucgccgagaacaagaucugggggcgcaagagcuggccccugaacgagggcaucauggccguggggaucgucagcauccugcucuccagccugcugaagaacgacgugccccucgccggcccccugaucgccggcgggaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgcgacgacacccucaccauccugcugaaggccacccuccuggccgucagcgggguguacccgcuguccauccccgccacccucuucgugugguacuucuggcagaagaagaagcagcggagcggcguccugugggacacccccagcccgcccgagguggagcgcgccgugcuggacgacggcaucuaccggaucaugcagcgcgggcugcucggccggagccaggucggggugggcguguuccaggagaacgucuuccacaccauguggcacgugacccgcggggcggugcugauguaccagggcaagcggcuggagcccuccugggccagcgucaagaaggaccucaucuccuacggcgggggcuggcgccugcgggggagcuggaacacgggcgaggagguccaggugaucgccgucgagcccgggaagaaccccaagaacgugcagaccgcccccggcaccuucaagacccccgagggcgaggugggggccaucgcgcuggacuucaagcccggcacguccgggagccccaucgucaaccgcgagggcaagaucgugggccucuacgggaacggcguggucaccaccagcgggaccuacguguccgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaagggcaugcccauccgcuaccagacgaccgccgucaagggggagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggcuacgaguggaucaccgacuuccccgggaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcggccggaucgggcgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcggucgacggggaguaccggcuccgcggcgaggcccggaagaccuucguggagcugaugcgccggggcgaccugcccguguggcucuccuacaaggucgccagcgagggguuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgcggccggccgccggagcgucuccggcgaccucauccuggagaucgggaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccggcggggucacccuguucuuccuguccggccggggccucgggaagaccagcaucggccugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggguggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgcgaggcccagaagcggaccgccgccggcaucaugaagaaccccaccguggacggcaucguggccaucgaccucgaccccgucguguacgacgcgaaguucgagaagcagcuggggcagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggccaacaucuuccggggcuccuaccuggcgggggccggccucgccuucagccugaugaagucccucgggggcgggcgccgggggaccggcgcccagggggagacccucggcgagaaguggaagcgccagcugaaccagcuguccaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagcccgagggcaaggugaucgaccuggggugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccgcacgcugcggguccucaagaugguggagcccuggcugcgcggcaaccaguucugcaucaagauccugaaccccuacaugcccagcguggucgagacccucgagcagaugcagcggaagcacgggggcaugcuggugcgcaacccgcugucccggaacagcacccacgagauguacuggguguccugcgggaccggcaacaucgucagcgcggugaacaugaccucccgcaugcuccugaaccgcuucacgauggcccaccggaagcccaccuacgagcgcgacguggaccugggcaccgggacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcggguguucaaggagaagguggacacccgcacgccgaaggccaagcggggcaccgcccagaucauggaggucaccgcccgcuggcucuggggguuccugucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcuccacaagcaggggaagugcgcgaccugcgucuacaacaugaugggcaagcgggagaagaagcugggggaguucggcaaggccaagggcagccgcgccaucugguacauguggcugggggcccgguuccucgaguucgaggcgcugggcuucaugaacgaggaccacugguucucccgcgagaacagccuguccgggguggagggcgaggggcuccacaagcugggcuacauccugcgggacaucagcaagauccccggcgggaacauguacgccgacgacaccgccggcugggacacccgcaucacggaggacgaccuccagaacgaggccaagaucaccgacaucauggagccggagcacgcccugcuggcgaaggccaucuucaagcucaccuaccagaacaaggugguccgcgugcagcggcccgccaagaacgggaccgugauggacgucaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcgcgcuggacuggcucgagaaguacggcguggagcggcugaagcgcauggccaucagcggggacgacugcgucgugaagccgaucgacgaccgguucgccacggcccugaccgcccucaacgacaugggcaaggugcgcaaggacaucccccagugggagcccucccggggcuggaacgacuggcagcagguccccuucugcagccaccacuuccaccagcugaucaugaaggacgggcgcgagaucguggugccgugccggaaccaggacgagcuggucggccgcgcgcgggugucccagggggccggcuggagccuccgcgagaccgccugccugggcaagagcuacgcccagauguggcagcugauguacuuccaccggcgcgaccuccggcuggcggccaacgccaucugcuccgccgugcccgucgacugggugcccaccagccgcacgaccugguccauccacgcccaccaccaguggaugaccaccgaggacaugcugagcguguggaaccgcgucuggaucgaggagaaccccuggauggaggacaagacgcacaucuccagcugggaggacgugccguaccucggcaagcgggaggaccaguggugcggcucccugaucgggcugaccgcgcgcgccaccugggccaccaacauccagguggccaucaaccagguccggcgccucaucggcaacgagaacuaccuggacuacaugaccagcaugaagcgguucaagaacgaguccgaccccgagggggcccugugguga

SEQ ID NO: 8632 - RNA, 9879 nt, Artificial Sequence
  derived and/or modified CDS sequence (opt1) from DENV-1__GU131726__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggccacgcagaacggccggcugaucaccgccaacccgaucgucaccgacaaggagaagcccgugaacaucgaggcggagccgcccuucggggaguccuacaucgugaucggcgccggcgagaaggcccugaagcucagcugguucaagaagggguccagcaucggcaagauguucgaggccaccgcccgcggggcgcggcgcauggccauccugggcgacacggccugggacuucggguccgucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgugggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucgccaccaacaucuggcugaagcugcgggacagcuacacccaggugugcgaccaccgccucauguccgccgccaucaaggacagcaaggccgugcacgcggacaugggcuacuggaucgaguccgagaagaacgagaccuggaagcuggcccgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggcgguguuccugcuccugaucauggggcagcugaccuggaacgaccucauccggcugugcaucauggucggcgccaacgccagcgaccgcauggggaugggcacgaccuaccuggcccucauggccaccuucaagaugcgcccgauguucgcgguggggcugcugcuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggccacccuccugagccugaccuucaucaagacgacccucucccugcacuacgcguggaagaccauggccaugguccugagcaucgugucccucuucccccugugccugagcaccacgucccagaagaccaccuggcuccccgugcugcugggcagcuucgggugcaagccgcucaccauguuccugaucacggagaacaagaucuggggccgcaaguccuggccccugaacgaggggaucauggccgucggcguggugagcauccuccugagcucccugcucaagaacgacgucccccuggccgggccccugaucgccggcggcaugcucaucgcgugcuacgugaucagcggguccagcccggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccccucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaacccgaagaacguccagaccgcccccgggaccuucaagacccccgagggcgaggugggcgccaucgcccucgacuucaagcccgggacgagcggcuccccgaucgugaaccgcgaggggaagaucgucggccuguacggcaacgggguggugaccaccagcggcaccuacgucagcgcgaucgcccaggccaaggccucccaggaggggccccugcccgagaucgaggacgagguguuccggaagcgcaaccucacgaucauggaccugcacccgggcagcgggaagacccggcgcuaccugcccgcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucuccccggugcgcgugcccaacuacaacaugaucaucauggacgaggcccacuucaccgaccccagcuccaucgccgcgcggggguacaucagcacccgcgucggcaugggggaggccgccgccaucuucaugaccgccacgcccccgggcuccguggaggcguucccccagagcaacgccgugauccaggacgaggagcgggacauccccgagcgcuccuggaacagcggguacgaguggaucaccgacuuccccggcaagaccgucugguucgugccguccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccccgccggugccucaagcccgucauccugaaggacgggcccgagcgcgugauccuggccggcccgaugcccgucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucaucccggcccucuucgagcccgagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccgcuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucaucccggagcccgaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccacccggccuccgccuggacgcuguacgccgucgcgaccaccaucaucacccccaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggugaacccgcugacgcucaccgccgccguccugaugcugguggcgcacuacgccaucaucggccccgggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccggcccgcugaccacccugugggaggggucccccggcaaguucuggaacacgaccaucgccgucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagccgauccccauggccaccuacggguggaaccuggugaagcuccacuccggcaaggacgucuucuucacgccgcccgagaagugcgacacccugcugugcgacaucggggagagcuccccgaaccccacgaucgaggagggccggacccuccgcgugcugaagaugguggagcccuggcugcgggggaaccaguucugcaucaagauccucaaccccuacaugccgagcgucguggagacccuggagcagaugcagcgcaagcacggcggcaugcuggugcggaacccccucucccgcaacagcacccacgagauguacugggucuccugcgggaccggcaacaucgugagcgccgugaacaugacgucccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaagagcacguggcacuacgacgaggacaacccguacaagaccugggccuaccacggguccuacgaggugaagcccagcggcuccgccagcagcauggucaacgggguggugaagcugcucaccaagcccugggacgucauccccauggugacccagaucgcgaugacggacaccaccccguucggccagcagcgcguguucaaggagaaggucgacacccggacgcccaaggccaagcgcgggaccgcccagaucauggaggugaccgcccgguggcuguggggcuuccugucccgcaacaagaagccccggaucugcacccgcgaggaguucacgcggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccggcgggaacauguacgcggacgacaccgccgggugggacacccgcaucacggaggacgaccugcagaacgaggccaagaucaccgacaucauggagcccgagcacgcccugcucgccaccuccaucuucaagcugaccuaccagaacaaggucgugcgggugcagcgccccgcgaagaacgggacggucauggacgugaucagccgccgggaccagcgcggcuccggccaggugggcaccuacggccugaacaccuucaccaacauggaggcccagcucauccggcagauggagagcgaggggaucuuccugcccuccgagcuggagacgccgaaccucgccgagcgcguccuggacuggcuggagaaguacggcguggagcggcucaagcgcauggccaucagcggggacgacugcguggucaagcccaucgacgaccgguucgccaccgcgcugaccgcccugaacgacaugggcaaggugcgcaaggacaucccccagugggagcccuccaagggguggaacgacuggcagcaggucccguucugcagccaccacuuccaccagcucaucaugaaggacggccgggagaucgucgugcccugccgcaaccaggacgagcuggugggccgggcccgcgucucccagggggccggcuggagccugcgggagaccgccugccucggcaagagcuacgcgcagauguggcagcugauguacuuccaccgccgggaccugcgccucgccgccaacgccaucugcuccgcggugcccaucgacugggugcccacgagccggaccaccugguccauccacgcccaccaccaguggaugaccacggaggacaugcugagcgucuggaaccgcguguggaucgaggagaacccguggauggaggacaagacccacguguccagcuggggcgacguccccuaccuggggaagcgggaggaccaguggugcggcucccucaucggccugaccgcccgcgccaccugggccagcaacauccagguggcgaucaaccaggugcgccggcugaucgggaacgagaacuaccucgacuacaugaccuccaugaagcgcuucaagaacgagggcgaccccgagggggcccugugguga

SEQ ID NO: 8633 - RNA, 9879 nt, Artificial Sequence
  derived and/or modified CDS sequence (opt1) from DENV-1__GU131727__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguaccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacacgaucgagacccucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggccguggagaaccaccaccacgcgacgaugcuggacgucgaccuccaccccgccuccgccuggacccuguacgccguggccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggucaacccccugacccucaccgccgccgugcugaugcugguggcccacuacgcgaucaucggcccggggcuccaggccaaggccacccgggaggcccagaagcgcacggccgcgggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggugagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugacggaggugaagggcuacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggacgggcaacaucgugagcgccgucaacaugaccucccggaugcugcugaaccgcuucaccauggcccaccgcaagcccaccuacgagcgggacguggaccucggggccggcacgcgccacguggcggucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgccaugaccgacaccacccccuucggccagcagcgcgucuucaaggagaagguggacacgcggaccccgaaggcgaagcgcgggaccgcccagaucauggaggugaccgcccgguggcuguggggcuuccugucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaagguggugcggguccagcgccccgccaagaacgggaccgugauggacgugaucagccgccgggaccagcgcggcuccgggcaggucggcaccuacggccugaacaccuucacgaacauggaggcgcagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgccaucaaccaggugcgccggcugaucgggaacgagaacuaccucgacuacaugacguccaugaagcgcuucaagaacgagggcgaccccgagggggcgcugugguga

SEQ ID NO: 8634 - RNA, 9879 nt, Artificial Sequence
  derived and/or modified CDS sequence (opt1) from DENV-1__HM631850__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggggaguucugcgaggacacgaugaccuacaagugcccccgcaucaccgaggccgagcccgacgacguggacugcuggugcaacgccaccgacacgugggugaccuacgggaccugcagccagaccggggagcaccggcgcgacaagcggagcguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaaccccaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccccggaccugagccuggagaaggccgccgagguguccugggaggaggaggccgagcacagcggcgccucccacaacauccucguggagguccaggacgacgggaccaugaagaucaaggacgaggagcgggacgacacccugaccauccugcucaaggcgacccugcuggccgugagcggcguguacccccucuccauccccgccacgcuguucgucugguacuucuggcagaagaagaagcagcgcagcggggugcugugggacacccccuccccgcccgagguggagcgggccguccucgacgacggcaucuaccgcaucaugcagcggggccugcuggggcgcagccaggugggcgugggggucuuccaggagaacguguuccacaccauguggcacgugacccggggcgccguccugauguaccaggggaagcgccucgagcccuccugggcgagcgugaagaaggaccugaucuccuacggcggcggguggcggcugcagggcagcuggaacacgggggaggaggugcaggucaucgccguggagcccggcaagaacccgaagaacgugcagaccgcccccgggaccuucaagaccuccgagggcgaggucggcgccaucgcccucgacuucaagcccgggacgagcggcagccccaucgugaaccgcgaggggaagaucgugggccuguacggcaacggggucgugaccaccuccggcaccuacgugagcgcgaucgcccaggccaaggccucccaggaggggccgcugcccgagaucgaggacgaggucuuccggaagcgcaaccucacgaucauggaccugcaccccggcagcgggaagacccggcgcuaccugccggcgaucgugcgggaggccaucaagcgcaagcuccggacccugauccuggcccccacccgcguggucgccuccgagauggccgaggcgcucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccucaagcccgugauccugaaggacgggcccgagcgcgucauccuggccggccccaugccggugacggucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccgcagcaccugacccagaaggcccagaacgcccuggacaaccucgugaugcugcacaacagcgagcagggcgggcgcgccuaccggcacgcgauggaggagcugcccgacaccaucgagacgcucaugcugcuggcccucaucgccgugcugaccggcggggucacccuguucuuccucuccggccgcgggcugggcaagaccagcaucggccugcucugcgugauggccuccagcgugcugcuguggauggccuccgucgagccccacuggaucgcggccagcaucauccucgaguucuuccugauggugcugcucauccccgagccggaccggcagcgcacgccccaggacaaccagcuggccuacguggucaucgggcuccucuucaugauccugacgguggccgccaacgagaugggccugcucgagaccaccaagaaggaccuggggaucggccacguggcggucgagaaccaccaccacgccgccaugcuggacguggaccuccaccccgccuccgccuggacccuguacgcgguggccacgaccaucaucaccccgaugaugcggcacaccaucgagaacacgaccgccaacaucagccugaccgccaucgccaaccaggcggccauccucauggggcuggacaagggcuggcccaucuccaagauggacaucggcgucccccugcucgcccuggggugcuacagccaggugaacccccugacccucacggccgcggugcugaugcuggucgcccacuacgccaucaucggcccggggcuccaggccaaggccacccgcgaggcgcagaagcggaccgccgccggcaucaugaagaaccccaccguggacgggaucguggccaucgaccuggaccccgucguguacgacgccaaguucgagaagcagcugggccagaucaugcuccugauccugugcacgucccagauccuccugaugcgcaccaccugggcgcugugcgagagcaucacccucgccacgggcccccugaccacccugugggagggguccccgggcaaguucuggaacaccacgaucgccgugagcauggccaacaucuuccgcgggagcuaccucgccggcgcgggccuggccuucucccugaugaagucccucgggggcgggcggcgcggcaccggggcccagggcgagacccugggcgagaaguggaagcggcagcugaaccagcucuccaagagcgaguucaacaccuacaagcgcuccgggaucauggaggucgaccggagcgaggccaaggagggccugaagcgcggggagacgaccaagcacgcggugucccggggcaccgccaagcugcgcugguucguggagcggaaccucgucaagcccgaggggaaggugaucgaccugggcugcggccgcgggggcuggagcuacuacugcgccgggcugaagaaggugaccgaggucaagggcuacacgaagggcgggcccggccacgaggagcccaucccgauggccaccuacggguggaaccuggugaagcuccacuccggcaaggacguguucuucaucccgcccgagaagugcgacacccugcugugcgacaucggggagagcucccccaacccgaccaucgaggagggccggacgcuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugaccucccggaugcugcugaaccgcuucacgauggcgcaccggaagcccaccuacgagcgcgacguggaccucggggccggcacccgccacgucgccguggagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcagcgcguccagcauggugaacggggucgugaagcugcucaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgccaaguggcuguggggcuuccugucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccucgugcaccgggagcgcgagcugcacaagcaggggaagugcgccacgugcgucuacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucaccgaggacgaccugcagaacgaggccaagaucacggacaucauggagccggagcacgcccugcucgcgaaguccaucuucaagcugaccuaccagaacaaggugguccgggugcagcgccccgccaagaacgggaccgugauggacgucaucagccggcgcgaccagcgcggcuccggccaggugggcaccuacggccugaacacguucaccaacauggaggcccagcucauccggcagauggagagcgaggggaucuucucccccagcgagcuggagacccccaaccuggccggccgcgugcucgacuggcuggagaagcacggggucgagcggcugaagcgcauggccaucuccggcgacgacugcguggugaagccgaucgacgaccgguucgcgaccgcccucacggcccugaacgacauggggaagguccgcaaggacaucccccagugggagcccagcaagggcuggaacgacuggcagcagguccccuucugcagccaccacuuccaccagcugaucaugaaggacggccgggagaucguggucccgugccgcaaccaggacgagcucguggggcgggcccgcgugucccagggcgccggguggagccugcgggagaccgcgugccugggcaaguccuacgcccagauguggcagcucauguacuuccaccgccgggaccugcgccuggccgccaacgcgaucugcagcgccguccccguggacugggugcccaccucccggaccacguggagcauccacgcccaccaccaguggaugaccaccgaggacaugcucuccgucuggaaccgcguguggaucgaggagaaccccuggauggaggacaagacccacaucagcaacuggggcgacgugccguaccugggcaagcgggaggaccaguggugcggcucccugaucgggcucacggcccgcgccaccugggcgaccaacauccaggucgccaucaaccaggugcggcgccugaucggcaacgagaacuaccuggacuacaugaccagcaugaagcgcuucaagaacgaguccgaccccgagggggcccucugguga

SEQ ID NO: 8635 - RNA, 9879 nt, Artificial Sequence
  derived and/or modified CDS sequence (opt1) from DENV-1__KF955446__SS-prME
agcgugaccauguuccugaugcucaugcccaccgcccuggccuuccaccugaccacccggggcggggagccccacaugaucgugagcaagcaggagcggggcaagagccuccuguucaagaccuccgccggggugaacaugugcacccugaucgccauggaccucggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccuggcgccccacgugggccucgggcuggagacccggaccgagaccuggaugagcuccgagggcgccuggaagcagauccagcggguggagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuucagcacgcaggacgagaagggggucacccagaacggccggcugaucaccgccaaccccaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccuccccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggcccgggccucccaggaggggccgcuccccgagaucgaggcggagguguuccgcaagcggaaccugaccaucauggaccugcaccccggcagcgggaagacccgccgguaccucccggccaucguccgcgaggccaucaagcgcaagcugcggacccugauccucgcccccacgcgcgugggcgccuccgagauggcggaggcccugaagggcaugcccauccgguaccagaccaccgccgucaagagcgagcacaccgggaaggagaucgucgaccugaugggccacgccacguucaccauggggcuccuggcccccggccgcgugccgaacuacaacauggugaucauggacgaggcgcacuucaccgaccccucccggaucgccgcccgcggguacaucagcacccgggucggcaugggcgaggccgccgcgaucuucaugacggccacgccgcccggguccguggaggccuucccgcagagcaacgccgugauccaggacgaggagcgcgacauccccgagcgguccuggaacagcggcuacgaguggaucaccgacuuccccgggaagaccgucugguucgugcccuccaucaagagcggcaacgacaucgcgaacugccugcgcaagaacgggaagcgggugauccagcucucccgcaagacguucgacaccgaguaccagaagaccaagaacaacgacugggacuacgucgugaccacggacaucagcgagaugggcgccaacuuccgggccgaccgcgugaucgacccgcggcgcugccugaaccccgucauccugaaggacggccccgagcgggugauccucgccgggcccaugccggugaccgucgccuccgcggcccagcgccggggccgcaucgggcgcaaccacaacaaggagggcgaccaguacaucuacauggggcagccccugaacaacgacgaggaccacgcccccuggaccgaggccaagaugcugcucgacaacaucaacacccccgagggcaucaucccggcccuguucgagcccgagcgggagaaguccgcggccaucgacggcgagucccgccugcgcggggaggcccgcaagacguucguggagcucaugcggcgcggcgaccugcccgucuggcugagcuacaagguggccuccgagggguuccaguacagcgaccggcgcuggugcuucgacggcgagcggaccaaccaggugcucgaggagaacauggccgucgagaucuggcccaaggagggcgagcgcaagaagcugcggccgcgcugccuggacgcgcggaccuacagcgacccccucgcccugcgcgaguucaaggaguucccgcccgggcggcgcuccgugagcggcgaccugauccucgagaucgggaagcugccgcacccccugacccagcggccccagaacgcccucgccacgcuggugaugucccacaccagcgagcagggcgggcgcgcguaccggcacgccauggaggagcugccggccaccaucgagacccucaugcugcuggcccucaucgccguccugaccggcggcgugacgcuguucuuccucuccgggcgcggccuggggaagaccagcaucggccugcucugcgugauggcguccagcguccugcuguggauggccuccguggagccccacuggaucgccgccagcaucauccucgaguucuuccugauggugcugcucauccccgagcccgacuccaacgccacccggcaggacaaccagcuggcguacgucgugaucgggcuccucuucaugauccugaccguggccgccaacgagaugggccugcucgagacgaccaagaaggaccugggcaucgggcacgucgccguggagaaccaccaccacgccgcgaugcuggacguggaccuccacccggccagcgccuggacccuguacgccgucgccaccacgaucaucacccccaugaugcgccacaccaucgagaacaccacggcgaacaucucccugaccgccaucgccaaccaggccgcgauccucaugggccuggccaagggguggcccaucagcaagauggacaucggcgugccccugcucgcccuggggugcuacucccaggugaacccgcugacccucaccgcccccguccugaugcuggugccccacuaccccaucaucggcccgggccuccaggccaaggcgacgcgcgaggcccagaagcggaccgccgccgggaucaugaagaaccccaccguggacggcaucgucgccaucgaccuggaccccgugguguacgacgcgaaguucgagaagcagcuggggcagaucaugcuccugauccugugcaccagccagauccuccugaugcgcacgaccugggcccugugcgaguccaucacccucgccaccggcccccugacgacccugugggagggcagcccggggaaguucuggaacaccaccaucgccgucuccauggccaacaucuuccggggcagcuaccucgcgggggccggccuggccuucagccugaugaagucccucgggggcggccgccgggggacgggcgcccagggggagacccugggcgagaaguggaagcgccagcugaaccagcucaccaagagcgaguucaacaccuacaagcgguccgggaucauggagguggaccgcagcgaggcgaaggagggccugaagcggggcgagacgaccaagcaccccgugucccgcgggaccgccaagcugcggugguucgucgagcgcacccucgugaagcccgagggcaaggugaucgaccuggggugcggccgcggcggguggagcuacuacugcgccgggcugaagaaggucacggaggugaagggguacaccaagggcgggcccggccacgaggacccgauccccauggggaccuacggcuggaaccuggugaagcuccgcuccggcaaggacgucuucuucaucccgcccgagaagugcgacacccugcugugcgacaucggggagagcuccccgaaccccaccaucgaggagggccggacgcuccgcgugcugaagaugguggagcccuggcugcgggggaaccaguucugcaucaagauccucaaccccuacauggccagcgucguggagacccuggagcagaugcagcgcaagcacggcggcaugcuggugcggaacccgcucucccgcaacagcacccacgagauguacugggucuccugggggaccggcaacaucgugagcgccgugaacaugacgucccgcaugcugcugaaccgguucaccauggcgcaccgcaagcccaccuacgagcgggacgucgaccucggggccggcacccgccacguggccguggagcccgaggucgccaaccuggacaucaucgggcagcggaucgagaacaucaagcacgagcacaagagcacguggcacuacgacgaggacaacccguacaagaccugggccuaccacggcuccuacgagggcaagcccagcggguccgcgagcagcauggugaacggcggggugaagcugcucaccaagcccugggacggcauccccauggucacccagaucgccaugacggacaccaccccguucgggcagcagcgcguguucaaggagaaggucgacacccggacgcccaaggccaagcgcggcaccgcccagaucauggaggugaccgccaaguggcuguggggcuuccugucccggaacaagaagccccgcaucugcacccgggaggaguucacgcgcaaggugcggagcaacgcggccaucggggccgucuucguggacgagaaccaguggaacuccgccaaggaggcgguggaggacgagcgcuucugggaccucguccaccgggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcguggagggggagggccugcacaagcugggcuacauccuccgggacaucagcaagauccccgggggcaacauguacgccgacgacaccgccgggugggacacccgcaucacggaggacgaccugcagaacgaggcccgcaucaccgacaucauggagccggagcacgcccugcucgcgaaguccaucuucaagcugaccuaccagaacaaggucgugcgggugcagcgccccgccaagaacggcaccgucauggacgugaucagccggcgcgaccagcggggguccggccaggugggcacguacgggcugaacaccuucaccaacauggaggcccagcucauccgccagauggagagcggcgggaucuucagcccccgggagcuggagacccccaaccuggccgagcgcguccucgacuggguggagaaguacggcguggagcggcuggagcgcauggccaucagcggggacgacugccugggcgagccgaucuacgaccgguucgcgacggcccucaccgcccugaacgacaugggcaagguccgcaaggacaucccccagugggagcccuccaagggguggaacgacuggcagcagggccccuucugcagccaccacuuccaccagcugaucaugaaggacgggcgggagaucguggugccgugccgcaaccaggacgagcucgucggccgggcccgcgugucccagggggccggcuggagccugcgggagaccgcgugccugggcaagagcuacgcccagauguggcagcucauggacuuccaccgccgggaccugcgccuggccgccaacgcgaucugguccgccgggcccggcgacuggauccccacccgccggacgaccuggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgggaggaccaguggugcgggagccugaucggccucacggcccgcgccaccugggcgaccaacauccagguggccaucaaccagguccggcgccugaucggcaacgagaacuaccuggacuacauggccuccaugaagcgguucaagaacgagagcgaccccgagggggcccucugguga

SEQ ID NO: 8636 - RNA, 9879 nt, Artificial Sequence
  derived and/or modified CDS sequence (opt1) from DENV-1__KF921942__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucgccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgccgggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggcggacuccgggugcgugaucaacuggaagggccgggagcugaagugcgggagcggcaucuucgugacgaacgagguccacaccuggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccguggucgugggggacguggccggcauccuggcccaggggaagaagaugauccggccccagcccauggaguacaaguacagcuggaaguccuggggcaaggccaagaucaucggcgcggacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggcggucuucuuccuccugaucauggggcagcugacguggaacgaccucauccgccugugcaucauggugggcgccaacgccagcgaccgcauggggaugggcaccaccuaccuggcccucauggccaccuucaagaugcggccgauguucgcggugggccugcuguuccgccggcucacgucccgcgagguccugcugcucaccaucgggcugagccugguggccuccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgcguggaagaccauggccaugguccucagcaucgugucccuguucccccugugccucagcacgaccucccagaagaccaccuggcugcccguccugcucggcagccuggggugcaagccgcugacgauguuccucaucgccgagaacaagaucuggggccggcgcuccuggccccugaacgaggggaucauggccgugggcaucgugagcauccugcucagcucccugcugaagaacgacgucccccucgccgggccccugaucgcgggcggcaugcugaucgccugcuacgugaucagcggguccagcgccgaccucucccuggagaaggccgccgaggugagcugggaggaggaggcggagcacuccggcgccagccacaacauccuggucgaggugcaggacgacgggaccaugaagaucaaggacgaggagcgggacgacacccucaccauccugcugaaggccacccuccuggccguguccggcgucuacccgcugagcauccccgccacccuguucgugugguacuucuggcagaagaagaagcagcgcuccggggugcugugggacacccccagcccgcccgaggucgagcgggcggugcuggacgacggcaucuaccgcaucaugcagcggggccugcucgggcgcucccaggugggcgucgggguguuccaggagaacguguuccacaccauguggcacgucacccggggcgccgugcugauguaccaggggaagcgccuggagcccagcugggccuccgugaagaaggaccucaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgcgaucgcccuggacuucaagcccgggacgagcggcucccccaucgugaaccgcgaggggaagaucgucggccucuacggcaacgggguggugaccaccagcggcaccuacgucagcgccaucgcccaggcgaaggccucccaggaggggccgcugcccgagaucgaggacgagguguuccggaagcgcaaccugacgaucauggaccuccaccccggcagcgggaagacccggcgcuaccugccggccaucgugcgggaggccaucaagcgcaagcugcgcacccucauccuggcccccacccgggucguggcguccgagauggccgaggcccugaagggcaugcccauccgcuaccagacgaccgccgucaagagcgagcacaccggcaaggagaucgucgaccucaugugccacgccaccuucacgaugcggcugcugucccccgugcgcgugccgaacuacaacaugaucaucauggacgaggcgcacuucaccgaccccagcuccaucgccgcccggggguacaucagcacccgcgucggcaugggggaggccgccgcgaucuucaugaccgccacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgcgaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgccgaccgggugaucgacccgcgccggugccugaagcccgucauccucaaggacgggcccgagcgcgugauccuggccggccccaugccggugacggucgccuccgcggcccagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgcggccaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcgcugcgggaguucaaggaguucgccgccggccgccggagcguguccggggaccucauccuggagaucggcaagcugccgcagcaccucacccagcgcgcccagaacgcgcuggacaaccuggugaugcuccacaacagcgagcagggcgggcgggccuaccgccacgccauggaggagcugcccgacaccaucgagacgcugaugcuccuggcccugaucgccguccucaccggcggggugacccuguucuuccuguccggccgggggcucggcaagaccagcaucggccugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucgggcugcuguucaugauccucacgguggcggccaacgagaugggccugcuggagaccaccaagaaggaccucgggaucggccacgucgccguggagaaccaccaccacgccgccaugcuggacguggaccugcaccccgcguccgccuggacccucuacgccgucgccacgaccaucaucaccccgaugaugcgccacaccaucgagaacacgaccgccaacaucagccugaccgcgaucgccaaccaggccgccauccugauggggcucgacaagggcuggcccaucuccaagauggacaucggcgugccccugcuggcgcucgggugcuacagccaggugaacccccugacccugacggccgccguccucaugcugguggcccacuacgccaucaucggcccggggcugcaggcgaaggccacccgcgaggcccagaagcggaccgccgccggcaucaugaagaaccccaccguggacgggaucgucgcgaucgaccucgaccccgugguguacgacgccaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgucagcauggcgaacaucuuccggggguccuaccuggccggcgccggccucgccuucagccugaugaagucccucgggggcgggcgccgggggaccggggcgcagggcgagacccucggcgagaaguggaagcgccagcugaaccagcuguccaagagcgaguucaacaccuacaagcgguccgggaucauggagguggaccgcagcgaggccaaggagggccucaagcgcggggagacgaccaagcacgccgugucccgcggcaccgccaagcugcggugguucgucgagcgcaaccuggugaagcccgaggggaaggugaucgaccugggcugcggccgcgggggcuggagcuacuacugcgccgggcucaagaaggucaccgaggugaagggcuacacgaagggcggccccggccacgaggagcccaucccgauggcgaccuacggguggaaccuggugaagcugcacuccggcaaggacgucuucuucaucccgcccgagaagugcgacacccuccugugcgacaucggggagagcucccccaacccgaccaucgaggagggccgcacgcugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugaccucccgcaugcuccugaaccgcuucacgauggcccaccggaagcccaccuacgagcgcgacgucgaccugggggccggcacccggcacguggccguggagcccgaggucgcgaaccucgacaucaucggccagcgcaucgagaacaucaagcacgagcacaagagcaccuggcacuacgacgaggacaaccccuacaagacgugggccuaccacggguccuacgaggugaagccgagcggcuccgccagcagcauggugaacggggucgugaagcugcugaccaagcccugggacgucauccccauggugacccagaucgccaugaccgacacgacccccuucggccagcagcggguguucaaggagaaggucgacacccgcaccccgaaggccaagcgggggacggcgcagaucauggaggugaccgccaaguggcucuggggcuuccugucccgcaacaagaagccccggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggcgcgcaucacggacaucauggagccggagcacgcccugcuggccaaguccaucuucaagcucaccuaccagaacaaggucgugcgcgugcagcggcccgccaagaacgggaccgucauggacgugaucagccgccgggaccagcgcggcuccggccagguggggaccuacggccugaacacguucaccaacauggaggcccagcugauccggcagauggagagcgaggggaucuucucccccagcgagcucgagacccccaaccuggcggagcgcguccuggacuggcucgagaaguacggcguggagcggcugaagcgcauggccaucuccggggacgacugcguggucaagccgaucgacgaccgguucgccaccgcccugacggcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcgcgcgucagccagggggccggcuggagccuccgggagaccgccugccuggggaaguccuacgcccagauguggcagcugauguacuuccaccgccgggaccuccgccuggcggccaacgccaucugcagcgccgugcccguggacuggauccccaccucccggaccacguggagcauccacgcccaccaccaguggaugaccaccgaggacaugcuguccgucuggaaccgcguguggaucgaggagaaccccuggauggaggacaagacccacaucagcuccuggggcgacgugccguaccucgggaagcgcgaggaccaguggugcggcagccugaucggccugacggcgcgggccaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8637 - RNA, 9879 nt, Artificial Sequence
  derived and/or modified CDS sequence (opt1) from DENV-1__JF937602__SS-prME
agcgugaccaugcugcucaugcugaugcccaccgcccuggccuuccaccucacgacccgcggcggggagccccacaugaucguguccaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuuccugacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaacuacauccugcuggagaacgacaugaagcucaccgugguggucggggacguggcgggcauccuggcccaggggaagaagaugauccggccccagcccauggaguacaaguacagcuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccguggucguggacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugaccuggaacgaccucauccggcugugcaucauggucggcgcgaacgccagcgaccgcauggggaugggcacgaccuaccuggcccucauggccaccuucaagaugcgcccgauguucgccgugggccugcuguuccggcgccucaccucccgggaggugcugcugcucacgaucgggcugagccuggucgcguccguggagcuccccaacagccuggaggagcugggcgacgggcucgccaugggcaucaugauccugaagcugcucaccgacuuccagucccaccagcugugggccacccugcucagccugaccuucguccgcacgaccuucucccugcacuacgccuggaagaccauggcgauggugcucagcaucgugucccuguucccccugugccucagcaccacgucccagaagaccaccuggcugcccguccugcucggcagccuggggugcaagccgcugaccauguuccucaucgccgagaacaagaucuggggccggaaguccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccguggucagcugggaggaggaggccgagcacuccggcgcgagccacaacauccugguggaggugcaggacgacgggacgaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacgcccagcccgcccgagguggagcgcgccgugcuggacgacggcaucuaccggaucaugcagcgcggccugcucgggcggucccaggucggcguggggguguuccaggagaacgucuuccacaccauguggcacgugacccgcggcgcggugcugauguaccaggggaagcggcuggagcccagcugggccuccgucaagaaggaccucaucagcuacggcggcggguggcgccugcagggcuccuggaacaccggggaggagguccaggugaucgccgucgagcccggcaagaaccccaagaacgugcagacggcccccgggaccuucaagaccagcgagggcgaggugggcgccaucgcgcuggacuucaagcccgggaccuccggcagccccaucgucaaccgggaggggaagaucgugggccucuacggcaacgggguggucacgaccagcggcaccuacguguccgccaucgcccaggccaaggcgagccaggaggggccccugccggagaucgaggacgagguguuccgcaagcggaaccugaccaucauggaccuccaccccggcuccgggaagacgcgccgguaccugcccgccaucguccgcgaggccaucaagcggaagcugcgcacccucauccuggccccgacccgcgugguggccagcgagauggcggaggcccugaagggcaugcccauccgguaccagaccacggccgucaaguccgagcacaccggcaaggagaucguggaccucaugugccacgccaccuucaccaugcgccugcugagccccgugcggguccccaacuacaacaugaucaucauggacgaggcccacuucacggacccguccagcaucgcggcccgcggguacaucuccacccgggugggcaugggggaggccgccgccaucuucaugaccgcgacgccgcccggcagcguggaggccuucccccaguccaacgccgucauccaggacgaggagcgcgacaucccggagcggagcuggaacuccggguacgaguggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgcgaacuuccgggccgaccgcgucaucgacccccggcgcugccugaagccggugauccucaaggacgggcccgagcgggucauccuggccggccccaugcccgugaccguggccagcgccgcgcagcgccgggggcgcaucggccggaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgcgagaaguccgccgcgaucgacggggaguaccgccuccggggcgaggcccgcaagaccuucgucgagcugaugcggcgcggggaccugccgguguggcucagcuacaagguggccagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgcggccggccggcgcuccgugagcggggaccucauccuggagaucggcaagcugccccagcaccucacccagcgggcccagaacgcccuggacaaccuggucaugcuccacaacuccgagcagggcgggcgcgcguaccggcacgccauggaggagcugccggacaccaucgagacccugaugcuccuggcccugaucgccgugcucacgggcggggugacccuguucuuccugagcggccgcgggcucggcaagaccuccaucggccugcugugcgucauggccagcuccgugcuccuguggauggcgagcguggagccccacuggaucgccgccuccaucauccuggaguucuuccucaugguccugcugauccccgagcccgaccggcagcgcaccccgcaggacaaccagcucgccuacguggugaucgggcugcuguucaugauccucaccgucgccgcgaacgagaugggccugcuggagacgaccaagaaggaccucgggaucggccacguggccguggagaaccaccaccacgccgccaugcuggacgucgaccugcaccccgccagcgcguggacccucuacgccguggccaccacgaucaucacccccaugaugcggcacaccaucgagaacaccacggccaacaucucccugaccgccaucgcgaaccaggccgccauccugauggggcucgacaagggcuggccgaucagcaagauggacaucggcgugccccugcuggcccucgggugcuacucccaggucaacccccugacccugaccgcggccgugcucaugcugguggcccacuacgccaucaucggccccgggcugcaggccaaggcgacgcgcgaggcccagaagcgcaccgccgccggcaucaugaagaacccgaccgucgacgggaucguggccaucgaccucgaccccguggucuacgacgcgaaguucgagaagcagcugggccagaucaugcugcucauccugugcaccagccagauccugcucaugcggacgaccugggcccugugcgaguccaucacccuggccaccggcccccucacgacccugugggaggggagccccggcaaguucuggaacaccaccaucgccguguccauggccaacaucuuccgcgggagcuaccuggcgggcgccggccucgccuucagccugaugaagucccucgggggcgggcggcgcgggacgggggcccagggcgagacccucggcgagaaguggaagcggcagcugaaccagcugagcaaguccgaguucaacaccuacaagcgcagcgggaucauggagguggaccgguccgaggcgaaggagggccucaagcgcggggagaccacgaagcacgccgucagccggggcaccgccaagcugcgcugguucguggagcggaaccuggugaagccggaggggaaggucaucgaccugggcugcggccgcgggggcugguccuacuacugcgccgggcucaagaaggugaccgaggugaagggcuacaccaagggcgggcccggccacgaggagcccauccccauggccacguacggguggaaccuggucaagcugcacagcggcaaggacguguucuucaucccgcccgagaagugcgacacccuccugugcgacaucggggaguccagccccaaccccaccaucgaggagggccggacccugcgcgugcucaagauggucgagccguggcugcgggggaaccaguucugcaucaagauccugaaccccuacaugcccuccgugguggagacgcucgagcagaugcagcgcaagcacggcggcaugcugguccggaacccccugagccgcaacuccacccacgagauguacugggugagcugcgggaccggcaacaucguguccgcggucaacaugaccagccggaugcuccugaaccgcuucaccauggcccaccgcaagccgacguacgagcgggacguggaccugggggccggcacccgccacguggccgucgagcccgagguggccaaccucgacaucaucggccagcggaucgagaacaucaagcacgagcacaaguccaccuggcacuacgacgaggacaaccccuacaagaccugggcguaccacgggagcuacgaggucaagcccuccggcagcgccagcuccauggugaacgggguggucaagcugcugacgaagccgugggacgugauccccauggugacccagaucgccaugaccgacaccacgcccuucggccagcagcgcgucuucaaggagaagguggacacccggacccccaaggccaagcgcgggaccgcccagaucauggaggugacggcgaaguggcucuggggcuuccugagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcgcgguuccucgaguucgaggcccugggcuucaugaacgaggaccacugguucagccgcgagaacucccugagcggggucgagggcgaggggcuccacaagcugggcuacauccugcgggacaucuccaagauccccgggggcaacauguacgccgacgacacggccggcugggacacccgcaucaccgaggacgaccuccagaacgaggccaagaucaccgacaucauggagcccgagcacgcgcugcuggccaagagcaucuucaagcucacguaccagaacaagguggugcggguccagcgcccggccaagaacgggaccgugauggacgugaucucccgccgggaccagcgcggcagcgggcaggucggcaccuacggccugaacaccuucacgaacauggaggcccagcugauccggcagauggaguccgaggggaucuucagccccuccgagcucgagacccccaaccuggccggccgcgugcuggacuggcucgagaagcacgggguggagcggcugaagcgcauggcgaucagcggcgacgacugcgucgugaagcccaucgacgaccgguucgccaccgcccugaccgcccucaacgacauggggaaggugcgcaaggacaucccgcagugggagcccuccaagggcuggaacgacuggcagcagguccccuucugcagccaccacuuccaccagcugaucaugaaggacggccgggagaucguggugcccugccgcaaccaggacgagcuggucgggcgggcccgcgugagccagggcgcgggguggucccuccgggagacggccugccugggcaagagcuacgcccagauguggcagcugauguacuuccaccgccgggaccuccgccuggccgcgaacgccaucugcuccgccgugccggucgacugggugcccaccagccggaccaccugguccauccacgcccaccaccaguggaugacgaccgaggacaugcugagcguguggaaccgcgucuggaucgaggagaaccccuggauggaggacaagacccacaucuccagcuggggcgacgugcccuaccucggcaagcgggaggaccaguggugcggcucccugaucgggcugaccgcccgcgcgacgugggccaccaacauccagguggccaucaaccagguccgccggcuccugggcaacgagaacuaccuggacuacaugaccagcaugaagcgcuucaagaacgaguccgacccggagggggcccucugguga

SEQ ID NO: 8638 - RNA, 9879 nt, Artificial Sequence
  derived and/or modified CDS sequence (opt1) from DENV-1__GU131729__SS-prME
agcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgccccccacgugggccuggggcuggagacccgcaccgagaccuggaugagcuccgagggcgcguggaagcagauccagcgggucgagacgugggcccuccgccacccgggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugggcaagcucugcaucgaggcgaagaucuccaacaccacgaccgacagccggugcccgacccagggcgaggccacccugguggaggagcaggacgccaacuucgucugccgccggacguucguggaccgcggguggggcaacgggugcggccuguucgggaagggcucccucaucaccugcgccaaguucaagugcgugaccaagcuggagggcaagaucguccaguacgagaaccugaaguacagcgugaucgugaccguccacacgggggaccagcaccaggugggcaacgaguccaccgagcacgggaccaccgccaccaucacgccccaggcgcccaccaccgagauccagcucaccgacuacggcgcccugacgcuggacugcagcccccggaccgggcucgacuucaacgagaugguccugcugaccaugaaggagaaguccuggcucgugcacaagcagugguuccuggaccugccgcuccccuggaccagcggcgccagcacgucccaggagaccuggaaccgccaggaccugcuggugaccuucaagaccgcccacgccaagaagcaggaggucguggugcucggcagccaggagggggcgaugcacacggcccugaccggcgccaccgagauccagaccuccgggacgaccaccaucuucgccggccaccugaagugccggcucaagauggacaagcugacccugaaggggaugagcuacgucaugugcacgggcuccuucaagcucgagaaggagcuggccgagacccagcacggcaccgugcuggugcagaucaaguacgaggggaccgacgcgcccugcaagauccccuucagcacgcaggacgagaagggcgucacccagaacgggcgccugaucaccgccaacccgaucgugaccgacaaggagaagcccgugaacaucgaggccgagccccccuucggcgaguccuacaucgucaucggcgccggggagaaggcgcucaagcugagcugguucaagaagggcuccagcaucgggaagauguucgaggccacggcccggggcgcccgccggauggccauccugggggacaccgcgugggacuucggcuccaucggcgggguguucaccagcgugggcaagcucguccaccagaucuucgggaccgccuacggcgugcuguucuccggggugagcuggacgaugaagaucggcaucggcguccugcucaccuggcuggggcugaacucccgcagcaccucccucagcaugaccugcaucgccgugggccuggugacgcuguaccucggggucauggugcaggccgacuccggcugcgugaucaacuggaaggggcgcgagcugaagugcggcagcggcaucuucgucaccaacgaggugcacaccuggaccgagcaguacaaguuccaggccgacagcccgaagcggcuguccgcggccaucgggaaggccugggaggagggcgugugcgggauccgcagcgccacccggcucgagaacaucauguggaagcagaucuccaacgagcugaaccacauccugcucgagaacgacaugaaguucacggucguggugggcgacgucgccgggauccuggcgcagggcaagaagaugauccgcccccagcccauggaguacaaguacagcuggaaguccuggggcaaggccaagaucaucggggccgacgugcagaacaccaccuucaucaucgacggccccaacaccccggagugccccgacgaccagcgggccuggaacaucugggagguggaggacuacggguucggcaucuucacgaccaacaucuggcugaagcuccgcgacagcuacacccaggucugcgaccaccggcugauguccgcggccaucaaggacagcaaggccgugcacgccgacaugggcuacuggaucgaguccgagaagaacgagaccuggaagcuggcccgcgcgagcuucaucgaggugaagacgugcaucuggcccaagucccacacccucuggagcaacgggguccuggaguccgagaugaucauccccaagaucuacggcgggccgaucagccagcacaacuaccggcccggcuacuucacccagaccgccgggcccuggcaccugggcaagcucgagcuggacuucgaccugugcgagggcacgaccgugguggucgacgagcacugcgggaaccgcggcccgucccuccggaccaccacggugaccgggaagaucauccacgaguggugcugccgcagcugcacccugcccccccugcgguuccgcggcgaggacgggugcugguacggcauggagauccggcccgugaaggagaaggaggagaaccucgucaaguccauggugagcgccggcagcggggagguggacuccuucagccugggccugcucugcaucuccaucaugaucgaggaggucaugcgcagccgguggucccgcaagaugcugaugaccgggacgcuggccguguucuuccuccugaucaugggccagcugaccuggaacgaccucauccggcugugcaucauggugggggccaacgcgagcgaccgcaugggcaugggcaccaccuaccuggcccucauggccacguucaagaugcgcccgauguucgccgucgggcugcuguuccggcgccucaccucccgggaggugcugcugcucaccaucggccugagccugguggccuccgucgagcuccccaacagccuggaggagcugggggacggccucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucgggagccugggcugcaagccgcugaccauguuccucaucgcggagaacaagaucugggggcgccgguccuggccccugaacgagggcaucauggccguggggaucgugagcauccugcucagcucccugcugaagaacgacgucccccucgccggcccccugaucgccggcgggaugcugaucgccugcuacgugaucagcggcuccagcgcggaccucucccuggagaaggccgccgaggugagcugggaggaggaggccgagcacuccggggccagccacaacauccuggucgaggugcaggacgacggcccgaugaagaucaaggacgaggagcgcgacgacacccucaccauccugcugaaggcgacccuccuggccguguccggggucuacccccugagcauccccgccacgcucuucgugugguacuucuggcagaagaagaagcagcgguccggcgugcugugggacacccccagcccgcccgaggucgagcgcgccgugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggcguccgugaagaaggaccucaucagcuacggcgggggcuggcgccugcagggguccuggaacacgggcgaggagguccaggugaucgccguggagcccgggaagaacccgaagaacguccagaccgcccccggcaccuucaagacccccgagggcgaggugggggccaucgcccuggacuucaagcccggcacgagcggguccccgaucgugaaccgggagggcaagaucgucggccucuacgggaacggcguggugaccaccagcgggaccuacgucagcgcgaucgcccaggccaaggccucccaggagggcccccugcccgagaucgaggacgagguguuccgcaagcggaaccugacgaucauggaccuccacccggggagcggcaagacccgccgguaccugcccgcgaucgugcgcgaggccaucaagcggaagcugcgcacccucauccuggcccccacccgcgucguggccuccgagauggccgaggcgcugaagggcaugcccauccgguaccagacgaccgccgugaagagcgagcacaccgggaaggagaucgucgaccucaugugccacgccaccuucacgaugcgccugcuguccccggugcgggugcccaacuacaacaugaucaucauggacgaggcccacuucaccgaccccagcuccaucgccgcgcgcggcuacaucagcacccgggucgggaugggcgaggccgccgccaucuucaugaccgccacgcccccgggguccguggaggcguucccccagagcaacgccgugauccaggacgaggagcgcgacauccccgagcgguccuggaacagcggcuacgaguggaucaccgacuuccccggcaagaccgucugguucgugccguccaucaagagcgggaacgacaucgccaacugccuccgcaagaacggcaagcgggugauccagcugucccgcaagaccuucgacacggaguaccagaagaccaagaacaacgacugggacuacgucgugaccaccgacaucagcgagaugggggccaacuuccgggcggcccgcgugaucgacccccggcgcugccugaagcccgucauccucaaggacggccccgagcgggugauccuggccgggccgaugcccgugacggucgccuccgccgcgcagcgccggggccgcaucggccggaaccacaacaaggagggggaccaguacaucuacaugggccagccccugaacaacgacgaggaccacgcccacuggaccgaggccaagaugcuccuggacaacaucaacacccccgaggggaucaucccggcccuguucgagcccgagcgcgagaagagcgccgcgaucgacggcgaguaccgccuccggggggaggcccgcaagaccuucguggagcugaugcggcgcggcgaccugcccgucuggcucuccuacaagguggccagcgagggcuuccaguacagcgaccggcgcuggugcuucgacggggagcggaacaaccaggugcuggaggagaacauggacgucgagaucuggacgaaggagggcgagcgcaagaagcugcggccccgcuggcucgacgcccggaccuacuccgacccgcuggcccugcgcgaguucaaggaguucgcggccgggcggcgcagcguguccggcgaccucauccuggagaucggcaagcugccccagcaccucacccagcgggcccagaacgcccuggacaaccuggugaugcuccacaacagcgagcaggggggccgcgcguaccggcacgccauggaggagcugcccgacaccaucgagacgcugaugcuccuggcccugaucgccguccucaccgggggcgugacccuguucuuccuguccgggcgcggccucggcaagaccagcaucgggcugcugugcgugauggccuccagcguccuccuguggauggcguccguggagccccacuggaucgccgccagcaucauccuggaguucuuccucauggugcugcugaucccggagcccgaccggcagcgcaccccccaggacaaccagcucgccuacgucgugaucggccugcuguucaugauccucacgguggccgcgaacgagauggggcugcuggagaccaccaagaaggaccucggcaucgggcacgucgccguggagaaccaccaccacgccgccaugcuggacguggaccugcacccggccuccgcguggacccucuacgccgucgccacgaccaucaucacccccaugaugcggcacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggugaacccgcugacccugacggcggccguccucaugcugguggcccacuacgccaucaucgggcccggccugcaggccaaggcgacccgcgaggcccagaagcgcaccgccgccgggaucaugaagaaccccaccguggacggcaucgucgccaucgaccucgaccccgugguguacgacgcgaaguucgagaagcagcugggccagaucaugcugcucauccugugcacgucccagauccugcucaugcggaccaccugggcccugugcgagagcaucacccuggccacggggccgcucaccacccugugggagggcucccccgggaaguucuggaacaccacgaucgccgucagcauggccaacaucuuccgcggcuccuaccuggcgggcgccgggcucgccuucagccugaugaagagccugggcgggggccggcgcgggaccggcgcccagggcgagacccucggggagaaguggaagcggcagcugaaccagcuguccaagagcgaguucaacaccuacaagcgcuccggcaucauggagguggaccggagcgaggcgaaggaggggcucaagcgcggcgagacgaccaagcacgccgugucccgggggaccgccaagcugcgcugguucgucgagcggacccuggugaagcccgagggcaaggugaucgaccugggcugcgggcgcggcggguggagcuacuacugcgccggccucaagaaggucacggaggugaagggguacaccaagggcggccccgggcacgaggagccgauccccauggccaccuacggcuggaaccuggugaagcugcacuccgggaaggacgucuucuucaucccccccgagaagugcgacacccuccugugcgacaucggcgagagcuccccgaaccccacgaucgaggaggggcggacccugcgcgugcucaagaugguggagcccuggcugcggggcaaccaguucugcaucaagauccugaaccccuacaugccgagcgucguggagacccucgagcagaugcagcgcaagcacggcgggaugcuggugcggaacccccugucccgcaacagcacccacgagauguacugggucuccugcggcaccgggaacaucgugagcgcggugaacaugacgucccggaugcuccugaaccgcuucaccauggcccaccgcaagcccaccuacgagcgggacgucgaccugggcgccggcacccgccacguggccguggagcccgaggucgccaaccucgacaucaucgggcagcggaucgagaacaucaagcacgagcacaagagcacguggcacuacgacgaggacaacccguacaagaccugggcguaccacggcuccuacgaggggaagcccagcggcuccgccagcagcauggggaacggcguggugaagcugcugaccaagcccugggacgucauccccauggugacccagaucgccaugacggacaccaccccguucggccagcagcgcgucuucaaggagaagguggacacccggacgcccaaggccaagcgcgggaccgcccagaucauggaggugaccgcgaaguggcucuggggcuuccugucccggaacaagaagccccgcaucugcacccgggaggaguucacgcgcaagguccggagcaacgccgccaucggggccguguucguggacgagaaccaguggaacuccgcgaaggaggccgucgaggacgagcgcuucugggaccuggugcaccgggagcgcgagcuccacaagcagggcaagugcgccaccugcguguacaacaugauggggaagcgggagaagaagcugggcgaguucggcaaggccaaggggagccgcgccaucugguacauguggcugggcgcgcgguuccucgaguucgaggcccugggguucaugaacgaggaccacugguucucccgcgagaacagccuguccggcgucgagggggagggccuccacaagcugggcuacauccugcgggacaucagcaagaucccggggggcaacauguacgccgacgacaccgccgggugggacacccgcaucacggaggacgaccuccagaacgaggcccggaucaccgacaucauggagcccgagcacgcgcugcuggccaaguccaucuucaagcucaccuaccagaacaagguggugcgcguccagcgccccgccaagaacggcaccgugauggacgugaucagccggcgcgaccagcggggcuccgggcaggucggcacguacgggcugaacaccuucaccaacauggaggcccagcugauccgccagauggagagcgagggcaucuucucccccagcgagcucgagaccccgaaccuggccgagcgggugcuggacuggcucgagaaguacgggguggagcgccugaagcggauggcgaucuccggcgacgacugcgucgugaagcccaucgacgaccgcuucgccacggcccugaccgcccucaacgacaugggcaaggugcggaaggacaucccccagugggagcccagcaagggguggaacgacuggcagcaggucccguucugcucccaccacuuccaccagcugaucaugaaggacggccgcgagaucguggugcccugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggauccccaccucccgcacgaccuggagcauccacgcccaccaccaguggaugaccaccgaggacaugcuguccguguggaaccggguguggaucgaggagaacccguggauggaggacaagacgcacaucagcuccuggggcgacguccccuaccucgggaagcgcgaggaccaguggugcggcagccugaucgggcugaccgcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8639 - RNA, 9879 nt, Artificial Sequence
  derived and/or modified CDS sequence (opt1) from DENV-1__GU131730__SS-prME
agcgugaccaugcugcugaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcgggccgacagcgggugcgucaucaacuggaagggccgcgagcugaagugcgggagcggcaucuucgugaccaacgaggugcacacguggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaagcugaccgugguggucggggacguggcgggcauccucgcccaggggaagaagaugauccgcccccagcccauggaguacaaguacuccuggaaguccuggggcaaggccaagaucaucggcgccgacgugcagaacaccacguucaucaucgacgggcccaacaccccggagugccccgacgaccagcgggcguggaacaucugggaggucgaggacuacggcuucgggaucuucaccaccaacaucuggcugaagcugcgcgacuccuacacccaggugugcgaccaccggcucaugagcgccgccaucaaggacuccaaggccgugcacgccgacaugggcuacuggaucgagagcgagaagaacgagaccuggaagcuggcgcgcgccuccuucaucgaggucaagaccugcaucuggcccaagagccacacccugugguccaacggcgugcucgagagcgagaugaucauccccaagaucuacgggggcccgaucucccagcacaacuaccggcccggguacuucacgcagaccgccggccccuggcaccuggggaagcuggagcucgacuucgaccugugcgagggcaccaccguggucguggacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgucaaggagaaggaggagaaccuggucaagagcauggugagcgccggcuccggcgaggucgacagcuucucccucgggcugcugugcaucagcaucaugaucgaggaggugaugcggucccgcuggagccggaagaugcucaugaccggcacccuggccguguucuuccugcucaucauggggcagcugaccuggaacgaccugauccgccucugcaucauggucggcgcgaacgccuccgaccgcauggggaugggcacgaccuaccuggcccugauggccaccuucaagaugcggccgauguucgccgugggccuccuguuccgccggcugaccagccgcgaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccggacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgugguguccugggaggaggaggccgagcacagcggcgcgucccacaacauccuggucgaggugcaggacgacgggacgaugaagaucaaggacgaggagcgggacgacacccugaccauccuccugaaggccacccugcucgccgugagcggcgucuacccgcuguccauccccgccacccuguucgugugguacuucuggcagaagaagaagcagcgcagcggggugcucugggacacgcccagcccgcccgaggucgagcgggccgugcuggacgacggcaucuaccgcaucaugcagcggggccugcuggggcgcagccaggugggcgucgggguguuccaggagaacguguuccacaccauguggcacgucacccggggcgcggugcucauguaccaggggaagcgccuggagcccuccugggccagcgugaagaaggaccugaucuccuacggcggcggguggcggcuccagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgcgaggggaagaucgucggccuguacggcaacgggguggugacgaccuccggcaccuacgucagcgccaucgcccaggccaaggcgucccaggaggggccccucccggagaucgaggacgagguguuccggaagcgcaaccugaccacgauggaccugcaccccggcagcgggaagacccggcgcuaccuccccgccaucgugcgggaggccaucaagcgcaagcugcgcacccugauccucgccccgacccgggucguggccuccgagauggcggaggcccugaagggcaugcccauccgcuaccagacgaccgccgucaagagcgagcacaccggcaaggagaucgucgaccugaugugccacgccaccuucacgaugcggcuccugucccccgugcgcgugcccaacuacaacaugaucaucauggacgaggcccacuucaccgacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagaccuucgacacggaguaccagaagaccaagaacaacgacugggacuacgucgugaccaccgacaucagcgagaugggcgcgaacuuccgcgccgaccgggugaucgacccccgccggugccugaagccggucauccugaaggacgggcccgagcgcgugauccucgccggccccaugcccgucacgguggccuccgccgcgcagcggcgcgggcggaucggccgcaacccgaacaaggagggcgaccaguacaucuacauggggcagccccugaacaacgacgaggaccacgcccccuggaccgaggccaagaugcugcucgacaacaucaacacccccgagggcaucaucccggcccuguucgagcccgagcgcgagaaguccgccgcgaucgacggggaguaccggcugcgcggcgaggcccggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggacgaaggagggggagcggaagaagcugcgcccccgguggcuggacgcccgcaccuacuccgacccgcucgcccugcgggaguucaaggaguucgcggccggccgccggagcguguccggggaccugauccucgagaucggcaagcugccccagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugaucccggagcccgaccgccagcggacgccccaggacaaccagcuggccuacgucgugaucgggcuccuguucaugauccugacgguggccgcgaacgagaugggccuccuggagaccaccaagaaggaccuggggaucggccacgucgccguggagaaccaccaccacgccgccaugcucgacguggaccugcacccggccuccgcguggacccuguacgccgucgccacgaccaucaucacccccaugaugcgccacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggugaacccgcucacccugacggcggccguccugaugcucguggcccacuacgccaucaucggccccgggcugcaggccaaggcgacccgcgaggcccagaagcggaccgccgccggcaucaugaagaaccccaccguggacgggaucgucgccaucgaccuggaccccgugguguacgacgcgaaguucgagaagcagcucggccagaucaugcugcugauccucugcacgucccagauccugcugaugcgcaccaccugggcccucugcgagagcaucacccuggccacgggcccgcugaccacccucugggaggggucccccggcaaguucuggaacaccacgaucgccgucagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggcgaaggagggccugaagcgcggggagacgaccaagcacgccgugucccgcggcaccgccaagcuccggugguucgucgagcgcaaccuggugaagcccgaggggaaggugaucgaccugggcugcggccgcggcggguggagcuacuacugcgccgggcugaagaaggucaccgaggugaagggguacacgaagggcgggcccggccacgaggagccgauccccauggccaccuacggguggaaccucgugaagcugcacuccggcaaggacgucuucuucaucccgcccgagaagugcgacacccugcucugcgacaucggggagagcuccccgaaccccaccaucgaggagggccgcacgcugcgggugcugaagaugguggagcccuggcuccgcgggaaccaguucugcaucaagauccugaaccccuacaugccgagcgucguggagacccuggagcagaugcagcggaagcacggcggcaugcucgugcgcaacccccugucccggaacagcacccacgagauguacugggucuccugcgggaccggcaacaucgugagcgcggugaacaugaccucccgcaugcugcucaaccgcuucacgauggcccaccggaagcccaccuacgagcgcgacgucgaccugggggccggcacccggcacguggccguggagcccgaggucgccaaccuggacaucaucggccagcgcaucgagaacaucaagcacgagcacaagagcaccuggcacuacgacgaggacaacccguacaagacgugggcguaccacggguccuacgaggugaagcccagcggcagcgccuccagcauggucaacgggguggugaagcuccugaccaagcccugggacgucauccccauggugacccagaucgccaugaccgacacgaccccguucggccagcagcggguguucaaggagaaggucgacacccgcacccccaaggccaagcgggggacggcccagaucauggaggugaccgcgaaguggcuguggggcuuccucucccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcgcuccuggccaaguccaucuucaagcugaccuaccagaacaaggucgugcgcgugcagcgccccgccaagaacgggaccgucauggacgugaucagccggcgcgaccagcggggcuccggccaggugggcaccuacggccucaacacguucaccaacauggaggcccagcugauccgccagauggagagcgaggggaucuucucccccagcgagcuggagaccccgaaccucgccggccggguccuggacuggcuggagaagcacgggguggagcgccucaagcggauggcgaucuccggcgacgacugcguggucaagcccaucgacgaccgcuucgccaccgcccugacggcccugaacgacauggggaaggugcggaaggacaucccccagugggagcccagcaagggcuggaacgacuggcagcaggucccguucugcagccaccacuuccaccagcucaucaugaaggacggccgcgagaucgucgugcccugccggaaccaggacgagcugguggggcgcgcccgggucucccagggcgcgggguggagccugcgcgagaccgccugccucggcaaguccuacgcccagauguggcagcugauguacuuccaccggcgcgaccugcggcucgccgcgaacgccaucugcagcgccgugcccguggacuggguccccaccucccgcaccacguggagcauccacgcccaccaccaguggaugaccaccgaggacaugcuguccguguggaaccggguguggaucgaggagaacccguggauggaggacaagacccacaucagcuccuggggcgacguccccuaccugggcaagcgcgaggaccaguggugcggcagccucaucgggcugacggcccgcgcgaccugggccaccaacauccagguggccaucaaccaggugcggcgccugcucggcaacgagaacuaccuggacuacaugaccuccaugaagcgguucaagaacgagagcgaccccgagggggcccugugguga

SEQ ID NO: 8640 - RNA, 9879 nt, Artificial Sequence
  derived and/or modified CDS sequence (opt1) from DENV-1__GU131731__SS-prME
agcgugaccaugcugcucaugcugaugcccaccgcccuggccuuccaccucaccacccggggcggggagccccacaugaucgugaccaagcaggagcggggcaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccgugggccugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcacccacaacaaggagggcgaccaguacaucagcauggggcagccccucaacaccgccgaggaccacgcgcccuggacggaggccaagaugcugcuggacaacaucaacacccccgagggcaucaucccggcccucuucgagcccgagcgggagaaguccgccgccaucgacggggaguaccgccugcgcggcgaggcgcggaagaccuucgucgagcugaugcgccgcggggaccuccccguguggcugagcuacaagguggccagcgagggcuuccaguacuccgaccgccgguggugcuucgacggcgagcgcaacaaccagguccuggaggagaacauggacguggagaucuggaccaaggagggggagcggaagaagcuccgcccccgguggcuggacgcccgcacguacagcgacccgcuggcccuccgggaguucaaggaguucgccgcgggccgccgguccgugagcggggaccugauccuggagaucggcaagcucccccagcaccugacccagcgcgcccagaacgcccuggacaaccucgucaugcugcacaacuccgagcagggcgggcgggccuaccgccacgcgauggaggagcugcccgacaccaucgagacccucaugcugcuggcccucaucgccgugcugaccggcggggugacgcuguucuuccucagcggccgggggcugggcaagaccuccaucggccugcucugcgucauggccagcuccgugcugcuguggauggccagcguggagccccacuggaucgcggccuccaucauccucgaguucuuccugaugguccugcucaucccggagcccgaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccacccggccagcgccuggacccuguacgccguggcgacgaccaucaucacccccaugaugcgccacaccaucgagaacacgaccgccaacaucucccugaccgccaucgccaaccaggccgcgauccucauggggcuggacaagggcuggcccaucagcaagauggacaucggcgugccccugcucgcccuggggugcuacucccaggucaacccgcugacccucacggccgccgugcugaugcugguggcgcacuacgccaucaucggccccgggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgagccagauccuccugaugcgcaccaccugggcccugugcgaguccaucacccucgcgacgggcccgcugaccacccugugggaggggagccccggcaaguucuggaacaccacgaucgccguguccauggccaacaucuuccgggggagcuaccucgccggcgccggccuggcguucagccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagaccacgcgccacgccgucagccggggcaccgcgaagcugcgcugguucguggagcggaaccuggugaagcccgaggggaaggucaucgaccucggcugcggccgcgggggcugguccuacuacugcgccgggcugaagaaggugaccgaggugaagggcuacaccaagggcgggcccggccacgaggacccgauccccauggccacguacggguggaaccuggucaagcuccacagcggcaaggacguguucuucacgccgcccgagaagugcgacacccugcugugcgacaucggggaguccagcccgaaccccaccaucgaggagggccggacccuccgcgugcugaagauggucgagcccuggcugcgggggaaccaguucugcaucaagauccucaaccccuacaugccguccgugguggagacgcuggagcagaugcagcgcaagcacggcggcaugcugguccggaacccccucagccgcaacuccacccacgagauguacugggugagcugcgggaccggcaacaucguguccgccgucaacaugaccagccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaaguccaccuggcacuacgacgaggacaacccguacaagacgugggccuaccacgggagcuacgaggucaagcccuccggcagcgccagcuccauggugaacgggguggucaagcugcucaccaagcccugggacgugauccccauggugacccagaucgcgaugaccgacacgaccccguucggccagcagcgcgucuucaaggagaagguggacacccggacccccaaggccaagcgcgggacggcccagaucauggaggugaccgcccgguggcuguggggcuuccugagccgcaacaagaagccccggaucugcacccgcgaggaguucacccggaagguccgcuccaacgccgcgaucggcgccguguucguggacgagaaccaguggaacagcgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgcggacgacaccgccggcugggacacccgcaucaccgaggacgaccugcagaacgaggccaagaucacggacaucauggagcccgagcacgcccugcucgccaccagcaucuucaagcugaccuaccagaacaagguggugcggguccagcgccccgcgaagaacgggaccgugauggacgugaucucccgccgggaccagcgcggcagcgggcaggucggcacguacggccugaacaccuucaccaacauggaggcccagcucauccggcagauggaguccgaggggaucuuccugcccagcgagcuggagaccccgaaccucgccgagcgcgugcuggacuggcuggagaaguacggcguggagcggcucaagcgcauggccaucuccggggacgacugcgucgugaagcccaucgacgaccgguucgccacggcgcugaccgcccugaacgacaugggcaaggugcgcaaggacaucccccagugggagcccagcaagggguggaacgacuggcagcaggucccguucugcucccaccacuuccaccagcucaucaugaaggacggccgggagaucguggugcccugccgcaaccaggacgagcuggucggccgggcccgcgugagccagggggccggcuggagccugcgggagaccgccugccucgggaaguccuacgcgcagauguggcagcugauguacuuccaccgccgggaccugcgccucgccgccaacgccaucugcagcgcggugcccgucgacugggugcccaccucccggacgaccuggagcauccacgcccaccaccaguggaugaccaccgaggacaugcuguccguguggaaccgcgucuggaucgaggagaacccguggauggaggacaagacccacgugagcuccuggggcgacgugcccuaccuggggaagcgggaggaccaguggugcggcagccucaucggccugacggcccgcgccaccugggccuccaacauccaggucgcgaucaaccaggugcgccggcugaucgggaacgagaacuaccucgacuacaugaccagcaugaagcgcuucaagaacgagggcgaccccgagggggcccugugguga

SEQ ID NO: 8641 - RNA, 9879 nt, Artificial Sequence
  derived and/or modified CDS sequence (opt1) from DENV-1__GU131733__SS-prME
agcgugaccauguuccugaugcucaugcccaccgcccuggccuuccaccugaccacccggggcggggagccccacaugaucgugagcaagcaggagcggggcaagagccuccuguucaagaccagcgccggggugaacaugugcacccugaucgccauggaccucggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccuggcgccccacgugggccucgggcuggagacccgcaccgagaccuggaugagcuccgagggcgccuggaagcagauccagcgggucgagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggcccgggccucccaggaggggccgcuccccgagaucgaggacgagguguuccgcaagcggaaccugaccaucauggaccugcaccccggcagcgggaagacccgccgguaccucccggcgaucguccgcgaggccaucaagcgcaagcugcggacccugauccucgcccccacgcgcgugguggccuccgagauggccgaggcgcugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggugauccucgccggccccaugccggucaccguggccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcguguccggggaccugauccucgagaucggcaagcugccgcagcaccugacccagcgggcccagaacgcccucgacaaccuggucaugcugcacaacagcgagcagggcgggcgcgccuaccggcacgcgauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggccuccguggagccccacuggaucgcggccagcaucauccuggaguucuuccugaugguccuccugauccccgagccggaccggcagcgcacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgggaggcgcagaagcgcaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcggaccaccugggcgcucugcgagagcaucacgcuggccaccggcccccugaccacccucugggagggguccccgggcaaguucuggaacacgaccaucgccgugagcauggccaacaucuuccgcggguccuaccuggccggcgcgggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggccaaggagggccugaagcgcggggagaccaccaagcacgcggucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugacgucccgcaugcugcucaaccgguucaccauggcgcaccgcaagcccaccuacgagcgggacguggaccugggggccggcacccgccacguggccgucgagcccgagguggccaacaucgacaucaucggccagcggaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcucaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgccaaguggcuguggggcuuccugucccggaacaagaagccccgcaucugcacccgggaggaguucacgcgcaagguccggagcaacgcggccaucggcgccguguucguggacgagaaccaguggaacuccgccaaggaggcggucgaggacgagcgcuucugggaccucgugcaccgggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccggggucgagggcgaggggcugcacaagcugggcuacauccuccgggacaucagcaagauccccgggggcaacauguacgccgacgacaccgccggcugggacacccgcaucacggaggacgaccugcagaacgaggcccgcaucaccgacaucauggagccggagcacgcccugcucgcgaaguccaucuucaagcugaccuaccagaacaagguggugcggguccagcgccccgccaagaacgggaccgugauggacgugaucagccggcgcgaccagcggggcuccgggcaggucggcacguacggccugaacaccuucaccaacauggaggcccagcucauccgccagauggagagcgaggggaucuucucccccagcgagcuggagacccccaaccuggccgagcgggugcucgacuggcuggagaaguacggcguggagcgccugaagcggauggccaucuccggggacgacugcgucgugaagccgaucgacgaccgcuucgcgacggcccucaccgcccugaacgacaugggcaaggugcggaaggacaucccccagugggagcccagcaagggguggaacgacuggcagcagguccccuucugcucccaccacuuccaccagcugaucaugaaggacggccgcgagaucguggugccgugccggaaccaggacgagcucgucggccgcgcccgggugagccagggggccggcuggagccugcgcgagaccgcgugccuggggaaguccuacgcccagauguggcagcucauguacuuccaccggcgcgaccugcggcuggccgccaacgcgaucugcagcgccgugcccgucgacuggauccccaccucccgcacgaccuggagcauccacgcccaccaccaguggaugaccaccgaggacaugcucuccguguggaaccgcguguggaucgaggagaaccccuggauggaggacaagacgcacaucagcuccuggggcgacgucccguaccuggggaagcgggaggaccaguggugcggcagccugaucggccucaccgcccgcgccaccugggcgaccaacauccagguggccaucaaccaggugcggcgccugaucgggaacgagaacuaccuggacuacaugaccuccaugaagcgguucaagaacgagagcgaccccgagggcgcccucugguga

SEQ ID NO: 8642 - RNA, 9879 nt, Artificial Sequence
  derived and/or modified CDS sequence (opt1) from DENV-1__GU131734__SS-prME
agcgugaccaugcugcucaugcugaugcccaccgcccuggccuuccaccucacgacccgcggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaugacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgacagcuucaagcuggagaaggagguggcggagacccagcacgggacggugcucguccagaucaaguacgagggcaccgacgcccccugcaagauccccuucuccacccaggacgagaagggcgugacccagaacgggcggcugaucacggccaacccgaucgugaccgacaaggagaagcccgucaacaucgaggccgagccgcccuucggcgagagcuacaucgugaucggggcgggcgagaaggcccugaagcuguccugguucaagaagggcagcuccaucgggaagauguucgaggccaccgcccgcggcgcccggcgcauggcgauccucggggacaccgccugggacuucggcagcaucgggggcguguucacguccgucggcaagcuggugcaccagaucuucgggaccgccuacggcgugcuguucagcggggucuccuggaccaugaagaucggcaucggggugcuccugaccuggcugggccucaacagccgcuccacgagccuguccaugaccugcaucgccgugggccuggucacccucuaccugggggugauggugcaggccgacagcggcugcgucaucaacuggaaggggcgggagcugaagugcggcagcgggaucuucgugaccaacgaggugcacacguggaccgagcaguacaaguuccaggcggacuccccgaagcgccucagcgccgccaucggcaaggccugggaggagggcgucugcgggauccgguccgccacccgccuggagaacaucauguggaagcagaucagcaacgagcugaaccacauccuccuggagaacgacaugaaguucaccgugguggucggcgacguggcggggauccuggcccagggcaagaagaugauccggccccagcccauggaguacaaguacuccuggaaguccugggggaaggccaagaucaucggcgccgacgugcagaacaccacguucaucaucgacggccccaacaccccggagugccccgacgaccagcgcgcguggaacaucugggaggucgaggacuacggguucggcaucuucaccaccaacaucuggcucaagcugcgggacuccuacacccaggugugcgaccaccgccugaugagcgccgccaucaaggacuccaaggccgugcacgccgacaugggguacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacggcgggccgaucucccagcacaacuaccgccccggcuacuucacgcagaccgccgggcccuggcaccucggcaagcuggagcuggacuucgaccucugcgaggggaccaccguggucguggacgagcacugcggcaaccggggcccgagccugcgcacgaccaccgugaccgggaagaucauccacgaguggugcugccgguccugcacgcugccgccccugcgcuucaagggcgaggacgggugcugguacggcauggagauccggcccgucaaggagaaggaggagaaccuggucaagagcauggugagcgccggguccggcgaggucgacagcuucucccugggccuccugugcaucagcaucaugaucgaggaggugaugcgcucccgguggagccgcaagaugcugaugaccgggacccucgccguguucuuccugcugaucaugggccagcucaccuggaacgaccugauccggcugugcaucauggucggggcgaacgccuccgaccgcaugggcauggggacgaccuaccucgcccugauggccaccuucaagaugcgcccgauguucgccgugggccuccuguuccggcgccugaccagccgggaggugcugcuccugacgaucggccugucccucgucgcgagcguggagcugcccaacucccuggaggagcucggggacggccuggccauggggaucaugauccugaagcuccugaucgacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccugggcugcaagccgcucaccauguuccugaucgccgagaacaagaucugggggcgcaagagcuggccccugaacgagggcaucauggccgucgggaucgugagcauccuccuguccgcccugcucaagaacgacgugccccuggccggcccccugaucgccggcgggaugcucaucgccugcuacgucaucagcggguccagcgccgaccugucccuggagaaggccgccgaggugagcugggaggaggaggcggagcacuccggggccagccacaacauccucguggagguccaggacgacggcaccaugaagaucaaggacgaggagcgggacgacacgcugaccauccugcucaaggccacccugcuggccguguccgggguguacccgcucagcauccccgccacccuguucgucugguacuucuggcagaagaagaagcagcgcuccggcgugcugugggacacccccagcccgcccgagguggagcgggcgguccucgacgacgggaucuaccgcaucaugcagcggggccugcugggccgcucccaggugggggugggcgucuuccaggagaacguguuccacacgauguggcacgugacccgcggggcgguccugauguaccagggcaagcggcucgagcccagcugggccuccgugaagaaggaccugaucagcuacgggggcggcuggcggcugcagggguccuggaacaccggcgaggaggugcaggucaucgccguggagcccgggaagaaccccaagaacgugcagaccgcccccggcacguucaagaccagcgagggggaggucggcgcgaucgcccucgacuucaagcccggcaccuccgggagccccaucgugaaccgcgagggcaagaucguggggcuguacggcaacggcgucgugaccacgagcgggaccuacguguccgccaucgcccaggcgaaggccagccaggagggcccccugccggagaucgaggacgaggucuuccggaagcgcaaccucaccaucauggaccugcaccccggguccggcaagacccggcgcuaccugcccgccaucgugcgggaggccaucaagcgcaagcuccggacgcugauccuggccccgacccgcguggucgcgagcgagauggccgaggcccucaaggggaugcccauccgcuaccagaccaccgccgugaaguccgagcacacgggcaaggagaucguggaccugaugugccacgccaccuucaccaugcggcugcucagccccguccgcgugcccaacuacaacaugaucaucauggacgaggcgcacuucaccgacccguccagcaucgccgcccggggcuacaucuccacgcgcguggggaugggcgaggccgccgcgaucuucaugaccgccacgccgcccgggagcgucgaggccuucccccaguccaacgccgugauccaggacgaggagcgggacaucccggagcgcagcuggaacuccggcuacgaguggaucaccgacuuccccgggaagacggugugguucguccccagcaucaaguccggcaacgacaucgcgaacugccugcggaagaacggcaagcgcgugauccagcugagccggaagaccuucgacaccgaguaccagaagaccaagaacaacgacugggacuacguggucacgaccgacaucuccgagaugggggccaacuuccgcgccgaccgggugaucgacccccgccggugccucaagccggugauccugaaggacggccccgagcgcgucauccuggccgggcccaugcccgugaccgucgccagcgcggcccagcggcgcggccggaucgggcgcaaccacaacaaggagggcgaccaguacaucuacaugggccagccgcucaacaacgacgaggaccacgcccacuggaccgaggccaagaugcugcuggacaacaucaacacgcccgaggggaucauccccgcccucuucgagcccgagcgggagaaguccgcggccaucgacggcgaguaccgccugcgcggggaggcccggaagaccuucguggagcugaugcgccggggcgaccucccgguguggcugagcuacaaggucgccagcgagggguuccaguacuccgaccgccgguggugcuucgacggcgagcgcaacaaccaggugcuggaggagaacauggacguggagaucuggaccaaggagggcgagcggaagaagcuccgcccccgguggcuggacgcccgcaccuacagcgacccccuggcgcuccgggaguucaaggaguucgccgccgggcgccgguccgucagcggcgaccugauccuggagaucgggaagcucccccagcaccugacgcagcgcgcccagaacgcgcuggacaaccucgugaugcugcacaacuccgagcagggcggccgggccuaccgccacgccauggaggagcugccggacaccaucgagacccucaugcugcuggcccucaucgccgugcugaccgggggcgucacgcuguucuuccucagcgggcggggccuggggaagaccuccaucggccugcucugcgugauggcgagcuccgugcugcuguggauggccagcgucgagccccacuggaucgccgccuccaucauccucgaguucuuccugauggugcugcucauccccgagcccgaccgccagcggaccccgcaggacaaccagcuggccuacguggucaucggccuccucuucaugauccugaccguggcggccaacgagauggggcugcucgagaccacgaagaaggaccugggcaucgggcacguggccgucgagaaccaccaccacgccgccaugcuggacguggaccuccaccccgcgagcgccuggacccuguacgccguggccaccaccaucaucacgcccaugaugcgccacaccaucgagaacaccaccgccaacaucucccugacggcgaucgccaaccaggccgccauccucaugggccuggacaagggguggccgaucagcaagauggacaucggcgucccccugcucgcgcugggcugcuacucccaggugaacccccugacccucaccgccgccgugcugaugcuggucgcccacuacgccaucaucgggcccggccuccaggcgaaggccacccgggaggcccagaagcgcacggccgccgggaucaugaagaacccgaccguggacggcaucguggcgaucgaccuggaccccgucguguacgacgccaaguucgagaagcagcuggggcagaucaugcuccugauccugugcaccagccagauccuccugaugcgcaccacgugggcccugugcgaguccaucacccucgccaccggcccccugaccacgcugugggagggcagccccgggaaguucuggaacaccaccaucgccguguccauggcgaacaucuuccggggcagcuaccucgccggggccggccuggccuucagccugaugaagucccucggcgggggccgccgggggaccggcgcgcagggggagacgcugggcgagaaguggaagcgccagcugaaccagcucagcaaguccgaguucaacaccuacaagcggagcggcaucauggaggucgaccgcuccgaggccaaggaggggcugaagcggggcgagaccaccaagcacgccgugagccgcgggacggccaagcugcggugguucguggagcgcaaccucgucaagccggagggcaaggugaucgaccuggggugcggccggggcgggugguccuacuacugcgccggccugaagaaggugaccgaggucaagggguacaccaagggcgggcccggccacgaggagcccauccccauggcgaccuacggcuggaaccuggugaagcuccacagcgggaaggacguguucuucaucccgcccgagaagugcgacacgcugcugugcgacaucggcgaguccagccccaaccccaccaucgaggaggggcgcacccuccggguccugaagaugguggagccguggcugcgcggcaaccaguucugcaucaagauccucaaccccuacaugcccuccguggucgagacccuggagcagaugcagcggaagcacgggggcaugcuggugcgcaacccccucagccggaacuccacgcacgagauguacugggugagcugcggcaccgggaacaucgucuccgccgugaacaugaccagccgcaugcugcugaaccgguucaccauggcccaccgcaagccgaccuacgagcgcgacguggaccucggcgccgggacgcggcacgucgccguggagcccgagguggcgaaccuggacaucaucggccagcgcaucgagaacaucaagcacgagcacaaguccaccuggcacuacgacgaggacaaccccuacaagaccugggccuaccacggcagcuacgaggucaagcccuccgggagcgccagcuccauggugaacggcgucgugaagcugcucaccaagccgugggacgugauccccauggucacgcagaucgccaugaccgacaccacccccuucgggcagcagcggguguucaaggagaagguggacacgcgcacccccaaggccaagcggggcaccgcgcagaucauggaggucaccgccaaguggcuguggggguuccugagccgcaacaagaagccgcggaucugcacgcgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcucccgggcgaucugguacauguggcucggggcccgcuuccuggaguucgaggcccugggcuucaugaacgaggaccacugguucagccgggagaacucccucagcggcguggagggggagggccugcacaagcugggguacauccuccgcgacaucuccaagauccccggcgggaacauguacgccgacgacaccgccggcugggacacgcggaucaccgaggacgaccugcagaacgaggcgaagaucaccgacaucauggagcccgagcacgcccugcucgccaagagcaucuucaagcugaccuaccagaacaaggugguccgcgugcagcggccggccaagaacggcacggugauggacgucaucucccgccgcgaccagcgggggagcggccagguggggaccuacggccugaacaccuucaccaacauggaggcccagcucauccgccagauggaguccgagggcaucuucagccccuccgagcuggagacgcccaaccuggcggggcgggugcucgacuggcuggagaagcacggcgucgagcgccugaagcggauggccaucagcggggacgacugcguggugaagcccaucgacgaccgcuucgccgccgcccucaccgcgcugaacgacaugggcaagguccggaaggacaucccgcagugggagcccuccaagggguggaacgacuggcagcagguccccuucugcagccaccacuuccaccagcugaucaugaaggacggccgcgagaucgugguccccugccggaaccaggacgagcucgugggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgccgucccgguggacugggugcccaccagccgcacgaccugguccauccacgcgcaccaccaguggaugaccaccgaggacaugcucagcgucuggaaccggguguggaucgaggagaaccccuggauggaggacaagacgcacaucuccagcuggggcgacgugcccuaccuggggaagcgcgaggaccaguggugcggcucccugaucggccucaccgcccgggccaccugggccaccaacauccaggucgccaucaaccaggugcgccgccugaucgggaacgagaacuaccuggacuacaugacgagcaugaagcgguucaagaacgaguccgacccggagggcgcgcucugguga

SEQ ID NO: 8643 - RNA, 9879 nt, Artificial Sequence
  derived and/or modified CDS sequence (opt1) from DENV-1__GU131738__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacgcucaucgccauggaccugggcgagcugugcgaggacaccaugaccuacaagugcccccgcaucaccgaggccgagcccgacgacguggacugcuggugcaacgccacggacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccgugggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucacggagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacccugcuggcggucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggccuccgucaagaaggaccugaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccucgacuucaagcccgggacgagcggcucccccaucgucaaccgcgaggggaagaucgugggccuguacggcaacgggguggucaccaccagcggcaccuacgugagcgccaucgcgcaggccaaggccucccaggaggggccgcugcccgagaucgaggacgagguguuccggaagcgcaaccucacgaucauggaccugcaccccggcagcgggaagacccggcgcuaccugccggccaucguccgggaggcgaucaagcgcaagcuccggacccugauccuggcccccacccgcgugguggccuccgagauggccgaggcccucaagggcaugcccauccgcuaccagacgaccgcggucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgggcgcuccuggaacagcggcuacgaguggaucaccgacuuccccggcaagaccgugugguucgggcccaccaucaaguccggcaacgacaucgccaacugccugcggaagaacgggaagcgcgugauccagcugagccggaagacguucgacaccgaguaccagaagaccaagaacaacgacugggacuacgucggcaccacggacaucuccgagaugggggccaacuuccgcgccgaccgggugaucgacccgcgccggugccucaagcccgugauccugaaggacggccccgagcgcgucauccuggcgggccccaugccggugaccgucgccagcgccgcccagcggcgcgggcggaucggccgcaaccacaacaaggagggggaccaguacaucuacaugggccagccccucaacaacgacgaggaccacgcccacuggaccgaggcgaagaugcugcuggacaacaucaacacccccgaggggaucauccccgcccucuucgagccggagcgggagaaguccgccgccaucgacggcgaguaccgccugcgcggcgaggcccggaagacguucguggagcugaugcgccgcggggaccuccccguguggcugagcuacaaggucgcguccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacagcgacccccuggcccuccgggaguucaaggaguucgccgccggccgccgguccgucagcggggaccugauccuggagaucggcaagcucccgcagcaccugacccagcgcgcgcagaacgcccuggacaaccucgugaugcugcacaacuccgagcagggcgggcgggccuaccgccacgccauggaggagcugcccgacacgaucgagacccucaugcugcuggcgcucaucgccgugcugaccgggggcgucacccuguucuuccucagcggccgggggcugggcaagaccuccaucgggcugcucugcgugauggccagcuccgugcugcuguggauggccagcgucgagccccacuggaucgccgcguccaucauccucgaguucuuccugauggugcugcucauccccgagccggaccgccagcggacgccccaggacaaccagcuggccuacguggucaucggccuccucuucaugauccugaccguggccgccaacgagauggggcugcucgagaccaccaagaaggaccugggcaucggccacguggccgucgagaaccaccaccacgcgacgaugcuggacguggaccuccaccccgccagcgccuggacccuguacgccguggccaccaccaucaucacgccgaugaugcgccacaccaucgagaacaccaccgcgaacaucucccugacggccaucgccaaccaggccgccauccucauggggcuggacaagggcuggcccaucagcaagauggacaucggggucccccugcucgcgcugggcugcuacucccaggugaacccccugacccucaccgccgccgugcugaugcuggucgcccacuacgcgaucaucgggccgggccuccaggccaaggccacccgggaggcccagaagcgcacggccgcgggcaucaugaagaaccccaccguggacgggaucguggccaucgaccuggaccccgucguguacgacgccaaguucgagaagcagcugggccagaucaugcuccugauccugugcaccagccagauccuccugaugcgcaccacgugggcccugugcgaguccaucacccucgccaccgggccccugaccacgcugugggagggcagcccgggcaaguucuggaacaccaccaucgcgguguccauggccaacaucuuccgggggagcuaccucgccggcgccgggcuggccuucucccugaugaagucccucggcgggggccgccggggcaccggggcgcagggcgagacgcugggggagaaguggaagcgccagcugaaccagcucagcaaguccgaguucaacaucuacaagcggagcggcaucauggaggucgaccgcuccgaggccaaggaggggcugaagcggggcgagaccacccgccacgccgugagccggggcaccgccaagcugcgcugguucguggagcggaaccuggucaagcccgaggggaaggugaucgaccucggcugcgggcgcggcgggugguccuacuacugcgcgggccugaagaaggugacggaggucaagggcuacaccaagggcgggcccgggcacgaggagcccaucccgauggccaccuacggcuggaaccuggugaagcuccacagcgggaaggacguguucuucacgccgcccgagaagugcgacacgcugcugugcgacaucggcgaguccagccccaacccgaccaucgaggagggccggacccuccgcguccugaagaugguggagcccuggcugcgggggaaccaguucugcaucaagauccucaaccccuacaugcccuccguggucgagacccuggagcagaugcagcgcaagcacggcgggaugcuggugcggaacccgcucagccgcaacuccacccacgagauguacugggugagcugcggcacgggcaacaucgucuccgccgugaacaugaccagccggaugcugcugaaccgcuucaccauggcccaccgcaagcccaccuacgagcgggacguggaccucggggccggcacgcgccacgucgcgguggagcccgagguggccaaccuggacaucaucgggcagcggaucgagaacaucaagcacgagcacaaguccaccuggcacuacgacgaggacaaccccuacaagaccugggccuaccacggcagcuacgaggucaagccguccgggagcgccuccagcauggugaacggcgucgugaagcugcucaccaagcccugggacgugauccccauggucacgcagaucgccaugaccgacaccacccccuucggccagcagcgcguguucaaggagaagguggacacgcggaccccgaaggcgaagcgcgggaccgcccagaucauggaggucaccgcccgguggcuguggggcuuccugagccgcaacaagaagccccggaucugcacgcgcgaggaguucacccggaaggugcgcuccaacgccgccaucggggcgguguucgucgacgagaaccaguggaacagcgccaaggaggccguggaggacgagcgguucugggaccucggccagaaggagcgcgagcugcacaagcaggggaagugcgcgaccugcguguacaacaugaugggcaagcgggagaagaagcugggcgaguucgggaaggcgaagggcucccgcgccaucugguacauguggcucggggcccgguuccuggaguucgaggcccugggcuucaugaacgaggaccacugguucagccgcgagaacucccucagcggggucgagggcgagggccugcacaagcugggguacauccuccgggacaucuccaagauccccggcgggaacauguacgccgacgacaccgcgggcugggacacgcgcaucaccgaggacgaccugcagaacgaggccaagaucaccgacaucauggagccggagcacgcccugcucgccaccagcaucuucaagcugacguaccagaacaagguggugcggguccagcgccccgccaagaacggcaccgugauggacgugaucucccgccgggaccagcgcgggagcggccaggucgggaccuacggccugaacaccuucacgaacauggaggcgcagcucauccggcagauggaguccgaggggaucuuccugcccagcgagcuggagacccccaaccucgccgagcgcgugcuggacuggcuggagaaguacggcguggagcggcucaagcgcauggccaucuccggcgacgacugcgucgugaagccgaucgacgaccgguucgccaccgcccugaccgcgcugaacgacauggggaaggugcgcaaggacaucccccagugggagcccagcaagggcuggaacgacuggcagcagguccccuucugcucccaccacuuccaccagcucaucaugaaggacgggcgggagaucguggugccgugccgcaaccaggacgagcuggucggccgggcccgcgugagccagggggccggcuggucccugcgggagacggccugccucggcaagagcuacgcccagauguggcagcugauguacuuccaccgccgggaccugcgccucgcggccaacgccaucugcagcgccgugcccgucgacugggugcccaccucccggaccaccuggagcauccacgcgcaccaccaguggaugacgaccgaggacaugcuguccguguggaaccgcgucuggaucgaggagaaccccuggauggaggacaagacccacgugagcuccuggggcgacgugccguaccugggcaagcgggaggaccaguggugcgggagccucaucggccugaccgcccgcgccaccugggccuccaacauccaggucgccaucaaccaggugcgccggcugaucgggaacgagaacuaccucgacuacaugacgagcaugaagcgcuucaagaacgagggcgaccccgagggcgcgcugugguga

SEQ ID NO: 8644 - RNA, 9879 nt, Artificial Sequence
  derived and/or modified CDS sequence (opt1) from DENV-1__JF937604__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaccuucggcacggccuacggggugcuguucuccggcgucagcuggaccaugaagaucgggaucggcgugcugcugaccuggcucggccugaacucccgcagcaccucccugagcaugacgugcaucgccguggggcucgucacccuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacgcgccuggagaacaucauguggaagcagaucuccaacgagcucaaccacauccugcuggagaacgacaugaaguucaccgugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgccuggaacaucugggaggucgaggacuacggcuucgggaucuucaccaccaacaucuggcugaagcugcgggacagcuacacccaggugugcgaccaccgccucauguccgcggccaucaaggacagcaaggccgugcacgccgacaugggcuacuggaucgaguccgagaagaacgagacguggaagcuggcccgggcgagcuucaucgaggucaagaccugcaucuggcccaagucccacacccuguggagcaacggcgugcucgaguccgagaugaucauccccaagaucuacgggggcccgaucagccagcacaacuaccgccccggguacuucacccagacggccggccccuggcaccuggggaagcuggagcucgacuucgaccugugcgagggcaccaccguggucguggacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugacgggcacccuggccguguucuuccugcucaucauggggcagcugaccuggaacgaccugauccgccucugcaucauggucggcgccaacgcgagcgaccgcauggggaugggcaccacguaccuggcccugauggccaccuucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugacggacuuccaguccuaccagcucugggccacccugcugagccucaccuucaucaagaccacguucucccugcacuacgccuggaagaccauggccaugguccugagcaucgugucccucuucccccugugccugagcaccaccucccagaagacgaccuggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugacgauccuccugaaggcgacccugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacacgauguggcacgugacccggggcgccguccucauguaccaggggaagcgccuggagcccagcugggcguccgugaagaaggaccugaucagcuacggcggcggguggcggcuccagggcuucuggaacaccggggaggaggugcaggucaucgccguggagcccggcaagaaccccaagaacgugcagaccgcccccgggacguucaagacccccgagggcgaggucggcgccaucgcccuggacuucaagcccgggaccuccggcagccccaucgugaaccgcgaggggaagaucgugggccuguacggcaacggggucgugaccacguccggcaccuacgugagcgcgaucgcccaggccaaggccagccaggaggggccgcuccccgagaucgaggacgaggucuuccggaagcgcaaccugaccaucauggaccugcaccccggcuccgggaagacccggcgcuaccucccggcgaucgugcgggaggccaucaagcgcaagcugcgcacgcugauccucgcccccacccggguggucgccagcgagauggccgaggcgcugaagggcaugcccauccgcuaccagaccaccgccgugaaguccgagcacacgggcaaggagaucguggaccugaugugccacgccaccuucaccaugcggcuccugagccccguccgcgugccgaacuacaacaugaucaucauggacgaggcccacuucaccgaccccuccagcaucgccgcgcggggguacaucuccacgcgcgugggcaugggggaggccgccgccaucuucaugaccgccacgccgcccggcagcgucgaggcguucccgcaguccaacgccgugauccaggacgaggagcgggacauccccgagcgcagcuggaacuccggguacgaguggaucaccgacuuccccggcaagacggugugguucguccccagcaucaaguccggcaacgacaucgccaacugccugcggaagaacgggaagcgcgugauccagcucagccggaagaccuucgacaccgaguaccagaagaccaagaacaacgacugggacuacguggucacgaccgacaucuccgagaugggcgccaacuuccgcgcggaccgggugaucgacccgcgccggugccugaagcccgugauccugaaggacgggcccgagcgcgucauccucgccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgcgagaaguccgccgccaucgacggggaguaccggcugcgcggcgaggcgcggaagaccuucguggagcucaugcgccgcggggaccugcccguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacgccgacccccucgcccugcgggaguucaaggaguucgcggccggccgccggagcgucuccggggaccugauccucgagaucggcaagcugccgcagcaccugacgcagcgcgcccagaacgcccucgacaaccuggugaugcugcacaacagcgagcagggcgggcgggcguaccgccacgccauggaggagcuccccgacaccaucgagacccugaugcugcucgcccugaucgccgugcugaccggcggggucacccucuucuuccuguccggccgggggcugggcaagacgagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagaccacgaagaaggaccuggggaucggccacguggccgucgagaaccaccaccacgccgccaugcucgacguggaccugcaccccgccuccgcguggacccuguacgccguggccaccaccaucaucacgccgaugaugcgccacaccaucgagaacaccaccgccaacaucagccucacggccaucgcgaaccaggccgccauccugauggggcuggacaagggcuggcccaucuccaagauggacaucggcgucccccuccuggcccuggggugcuacagccaggugaacccccucacccugaccgcggccgugcugaugcucgucgcccacuacgccaucaucggcccggggcugcaggccaaggcgacccgcgaggcccagaagcggacggccgccggcaucaugaagaaccccaccguggacgggaucguggccaucgaccuggaccccgucguguacgacgcgaaguucgagaagcagcucggccagaucaugcugcugauccucugcaccucccagauccugcugaugcgcaccacgugggcccucugcgagagcaucacccuggccaccggcccccugaccacgcucugggagggguccccgggcaaguucuggaacaccaccaucgccgugagcauggccaacaucuuccggggguccuaccuggcgggcgccggccuggccuucagccucaugaagucccucgggggcgggcgccgggggaccggggcccagggcgagacgcugggcgagaaguggaagcgccagcucaaccagcugagcaagagcgaguucaacaccuacaagaaguccgggaucauggaggucgaccggagcgaggcgaaggagggccugaagcgcggggagaccaccaagcacgccgugucccggggcacggccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcgggcccggccacgaggagcccaucccgauggccaccuacggguggaaccucgugaagcugcacuccggcaaggacguguucuucaucccgcccgagaagugcgacacgcugcucugcgacaucggggagagcucccccaacccgaccaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggacgggcaacaucgucagcgcggugaacaugaccucccggaugcugcucaaccgcuucaccauggcccaccgcaagcccaccuacgagcgggacguggaccugggggccggcacgcgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagccgagcggcuccgccagcuccauggugaacggggucgugaagcuccugaccaagcccugggacgugauccccauggucacgcagaucgccaugaccgacaccacccccuucggccagcagcgcguguucaaggagaagguggacacgcggaccccgaaggccaagcaggggaccgcccagaucauggaggucaccgcgaaguggcuguggggcuuccucagccgcaacaagaagccccggaucugcacgcgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagccagauccccgggggcaacauguacgccgacgacaccgccggcugggacacgcggaucaccgaggacgaccugcagaacgaggcccgcaucaccgacaucauggagccggagcacgcgcuccuggccaaguccaucuucaagcugaccuaccagaacaaggugguccgggugcagcgccccgccaagaacgggacggugauggacgucaucagccgccgggaccagcgcggcuccggccagguggggaccuacggccucaacaccuucaccaacauggaggcccagcugauccggcagauggagagcgaggggaucuucucccccagcgagcuggagacgcccaaccucgccgagcgcgugcuggacuggcuggagaaguacggcgucgagcggcucaagcgcauggcgaucuccggggacgacugcguggugaagccgaucgacgaccgguucgccaccgcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggcgggcuggucccugcgggagaccgccugccucggcaagagcuacgcccagauguggcagcugauguacuuccaccgccgggaccugcgccucgccgcgaacgccaucugcagcgccguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccuggggaagcgggaggaccaguggugcggcagccucaucggccugaccgcccgcgcgaccugggccaccaacauccagguggccaucaaccagguccgccggcugaucgggaacgagaacuaccucgacuacaugacguccaugaagcgcuucaagaacgagagcgaccccgagggcgcccugugguga

SEQ ID NO: 8645 - RNA, 9879 nt, Artificial Sequence
  derived and/or modified CDS sequence (opt1) from DENV-1__JF937605__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgcugcaggagaccuggaaccggcaggaccugcucgugaccuucaagaccgcccacgccaagaagcaggaggucguggugcugggcucccaggagggcgcgaugcacacggcccugaccggggccaccgagauccagaccagcggcacgaccaccaucuucgccgggcaccucaagugccgccugaagauggacaagcugacccucaagggcauguccuacgucaugugcacggggagcuucaagcuggagaaggagguggccgagacccagcacggcaccgugcugguccagaucaaguacgagggcaccgacgcgcccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccgucgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucacggugguggucggggacguggccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggcccaagagccacacccucugguccaacggcgugcuggagagcgagaugaucauccccaagaucuacgggggcccgaucucccagcacaacuaccgccccggguacuucacccaggccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuuccgcggggaggacggcugcugguacgggauggagauccgccccgucaaggagaaggaggagaaccucgucaagagcaugguguccgccggcagcggcgaggucgacagcuucucccuggggcugcucugcaucagcaucaugaucgaggaggugaugcggucccgcuggagccggcgcaugcugaugaccggcacccuggccguguucuuccuccugaucauggggcagcugacguggaacgaccucauccgccugugcaucauggucggcgcgaacgccuccgaccggauggggaugggcaccaccuaccuggcccucauggccaccuucaagaugcgcccgauguucgccgugggccugcuguuccggcgccucacgagccgggaggugcugcugcucaccaucgggcugucccuggucgcgagcguggagcuccccaacucccuggaggagcugggcgacgggcucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccgugcugcucggcucccuggggugcaagccgcugacgauguuccucaucgccgagaacaagaucuggggccgccggagcuggccccugaacgaggggaucauggccgucggcaucguguccauccugcucagcagccugcugaagaacgacgugccccucgccgggccccugaucgccggcggcaugcugaucgcgugcuacgucaucuccgggagcuccgccgaccucagccuggagaaggccgccaagguguccugggaggaggaggccgagcacagcggcgcgucccacaacauccugguggagguccaggacgacgggaccaugaagaucaaggacgaggagcgcgacgacacccucaccauccugcugaaggccacccuccuggccgugagcggcguguacccgcuguccauccccgccacccuguucgucugguacuucuggcagaagaagaagcagcggagcggggugcugugggacacccccagcccgcccgagguggagcgcgccguccuggacgacggcaucuaccggaucaugcagcgcggccugcucgggcggagccaggugggcgugggggucuuccaggagaacguguuccacaccauguggcacgugacccgcggcgcgguccugauguaccaggggaagcggcuggagcccuccugggccaacgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacguguccgccaucgcccaggccaaggcgagccaggaggggccgcugcccgagaucgaggacgaggucuuccgcaagcggaaccugacgaucauggaccuccaccccggcagcgggaagacccgccgguaccugccggccaucgugcgcgaggccaucaagcgcaagcugcggacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgggagaaguccgccgcgaucgacggggaguaccgccuccggggcgaggcccgcaagaccuucguggagcugaugcggcgcggggaccugcccguguggcucuccuacaaggucgccagcgagggcuuccaguacuccgaccggcgcuggugcuucgacggcgagcggaacaaccaggugcuggaggagaacauggacguggagaucuggacgaaggagggggagcgcaagaagcugcggccccgcuggcucgacgcccggaccuacagcgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgggaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcugagcaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccgcaugcuccugaaccgguucacgauggcccaccgcaagcccaccuacgagcgggacguggaccugggggccggcacccgccacgucgccguggagcccgagguggccaaccucgacaucaucggccagcggaucgagaacaucaagcacgagcacaagagcaccuggcacuacgacgaggacaaccccuacaagacgugggcguaccacggguccuacgaggucaagccgagcggcuccgccagcuccauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcucuggggcuuccugagccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggcccgcaucacggacaucauggagccggagcacgcgcugcuggccaaguccaucuucaagcucaccuaccagaacaaggugguccgggugcagcgccccgccaagaacgggaccgugauggacgucaucagccggcgcgaccagcggggcuccggccagguggggaccuacggccugaacacguucaccaacauggaggcccagcugauccgccagauggagagcgaggggaucuucucccccagcgagcucgagacccccaaccuggccgagcgggugcuggacuggcucgagaaguacggcgucgagcgccugaagcggauggcgaucuccggggacgacugcguggugaagccgaucgacgaccgcuucgccaccgcccugacggcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggcgggcuggucccuccgcgagaccgccugccugggcaagagcuacgcccagauguggcagcugauguacuuccaccggcgcgaccuccggcuggccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccucgggaagcgggaggaccaguggugcggcagccugaucggccugacggcccgcgcgaccugggccaccaacauccagguggccaucaaccagguccggcgccucaucgggaacgagaacuaccuggacuacaugaccuccaugaagcgguucaagaacgagagcgaccccgagggcgcccugugguga

SEQ ID NO: 8646 - RNA, 9879 nt, Artificial Sequence
  derived and/or modified CDS sequence (opt1) from DENV-1__JF937608__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagaaggucgagacgugggcccuccggcaccccggguucaccgugaucgcccuguuccuggcccacgcgaucggcaccagcaucacccagaaggggaucaucuucauccuccugaugcuggugacgcccuccauggccaugcgcugcgucggcaucggcagccgggacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcgcaagcucugcaucgaggcgaagaucuccaacaccacgaccgacagccggugcccgacccagggcgaggccacccugguggaggagcaggacgccaacuucgugugccgccggacguucgucgaccgcggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccggaccggccucgacuucaacgagauggugcugcugaccaugaaggagaaguccuggcucguccacaagcagugguuccuggaccugccccuccccuggaccagcggggccagcacgucccaggagaccuggaaccgccaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccgccugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccgccggauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgcgagcucaagugcgggagcggcaucuucgucaccaacgaggugcacaccuggaccgagcaguacaaguuccaggccgacagcccgaagcggcuguccgcggccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggagguggaggacuacggcuucgggaucuucacgaccaacaucuggcugaagcugcgcgacagcuacacccaggucugcgaccaccggcucauguccgcggccaucaaggacagcaaggccgugcacgccgacaugggcuacuggaucgaguccgagaagaacgagaccuggaagcuggcccgcgcgagcuucaucgaggugaagacgugcaucuggcccaagucccacacccuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccgugguggucgacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacgcuggccguguuccugcuccugaucauggggcagcugaccuggaacgaccucauccggcugugcaucauggugggcgccaacgcgagcgaccgcauggggaugggcaccaccuaccuggcccucauggccacguucaagaugcgcccgauguucgccgucgggcugcuguuccggcgccucaccucccgggaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccgccgguccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgcgacgacacccucaccauccugcugaaggcgacgcuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacaccauguggcacgugacgcgcggcgccgugcugauguaccaggggaagcggcuggagcccagcugggcguccgucaagaaggaccucaucagcuacggcggcggguggcgccugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgggaggggaagaucgugggccucuacggcaacgggguggucaccacgagcggcaccuacgugagcgccaucgcgcaggccaaggccucccaggaggggccgcugcccgagaucgaggacgagguguuccgcaagcggaaccugaccaucauggaccuccaccccggcagcgggaagacccgccgguaccugccggccaucguccgcgaggcgaucaagcggaagcugcgcacgcucauccuggcccccacccgcgugguggccuccgagauggccgaggcccugaagggcaugcccauccgguaccagaccaccgcggucaagagcgagcacacgggcaaggagaucguggaccucaugugccacgccaccuucaccaugcgccugcugucccccgugcgggucccgaacuacaacaugaucaucauggacgaggcccacuucaccgaccccagcuccaucgccgcccgcggguacaucagcacgcgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucaccgacuuccccggcaagacggugugguucgugcccuccaucaagagcggcaacgacaucgccaacugccuccgcaagaacgggaagcgggucauccagcugucccgcaagaccuucgacaccgaguaccagaagaccaagaacaacgacugggacuacguggugacgaccgacaucagcgagaugggcgccaacuuccgggccgaccgcgucaucgacccgcggcgcugccugaagcccgugauccucaaggacgggcccgagcgggugauccuggcgggccccaugccggucaccguggccuccgccgcccagcgccgggggcgcaucggccggaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccgccuccggggcgaggcccgcaagaccuucgucgagcugaugcggcgcggggaccugcccguguggcucuccuacaagguggcgagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacuccgacccccuggcccugcgcgaguucaaggaguucgccgccggccggcgcagcguguccggggaccucauccuggagaucggcaagcugccgcagcaccucacgcagcgggcgcagaacgcccuggacaaccuggucaugcuccacaacagcgagcagggcgggcgcgccuaccggcacgccauggaggagcugcccgacaccaucgagacccugaugcuccuggcgcugaucgccgugcucaccggcggggugacccuguucuuccuguccggccgcgggcucggcaagacgagcaucggccugcugugcgucauggccuccagcgugcuccuguggauggccuccguggagccccacuggaucgccgcgagcaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcggcacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcgcacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcggaccacgugggcccugugcgagagcaucacccuggcgaccgggccccucaccacgcugugggagggcuccccggggaaguucuggaacaccaccaucgccgugagcauggccaacaucuuccgcggcuccuaccuggccggcgccgggcucgcguucagccugaugaagucccugggcgggggccggcgcgggaccggcgcccagggcgagacgcucggggagaaguggaagcggcagcugaaccagcuguccaagagcgaguucaacaccuacaagcgcuccggcaucauggagguggaccggagcgaggccaaggaggggcucaagcgcggcgagaccaccaagcacgccgucucccgggggacggcgaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacccacgagauguacuggguguccugcggcacggggaacaucgugagcgccgucaacaugaccucccggaugcuccugaaccgcuucaccauggcccaccgcaagcccaccuacgagcgggacguggaccugggcgcgggcacgcgccacguggccgucgagcccgagguggccaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgcgucuucaaggagaagguggacacgcggaccccgaaggccaagcgcggcaccgcccagaucauggaggugaccgccaaguggcucuggggcuuccugucccggaacaagaagccccgcaucugcacgcgggaggaguucacccgcaagguccggagcaacgccgcgaucggggccguguucguggacgagaaccaguggaacuccgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgcggacgacaccgccgggugggacacgcgcaucaccgaggacgaccuccagaacgaggcccggaucaccgacaucauggagccggagcacgcccugcuggccaaguccaucuucaagcucaccuaccagaacaagguggugcgcguccagcgccccgcgaagaacggcacggugauggacgugaucagccggcgcgaccagcggggguccggccaggucggcaccuacgggcugaacaccuucaccaacauggaggcccagcugauccgccagauggagagcgagggcaucuucucccccagcgagcucgagacgcccaaccuggccgagcgggugcuggacuggcucgagaaguacgggguggagcgccugaagcggauggccaucuccggcgacgacugcgucgugaagccgaucgacgaccgcuucgccaccgcgcugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgccggguggagccuccgcgagaccgccugccugggcaaguccuacgcgcagauguggcagcugauguacuuccaccggcgcgaccuccggcuggccgccaacgccaucugcagcgcggugcccgucgacuggauccccacgucccgcaccaccuggagcauccacgcccaccaccaguggaugaccacggaggacaugcuguccguguggaaccggguguggaucgaggagaaccccuggauggaggacaagacccacaucagcuccuggggcgacgucccguaccucggcaagcgcgaggaccaguggugcggcagccugaucgggcugaccgcccgcgccaccugggccaccaacauccagguggcgaucaaccaggugcggcgccucaucggcaacgagaacuaccuggacuacaugacguccaugaagcgguucaagaacgagagcgaccccgagggggcccugugguga

SEQ ID NO: 8647 - RNA, 9879 nt, Artificial Sequence
  derived and/or modified CDS sequence (opt1) from DENV-1__GU131739__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacaccccgaccauccuccugaaggcgacgcugcucgccgucuccggcguguacccccugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaacccgaagaacgugcagaccgcccccgggaccuucaagacgcccgagggcgaggugggcgccaucgcccuggacuucaagcccgggaccagcggcuccccgaucgucaaccgcgaggggaagaucgugggccuguacggcaacgggguggucaccaccagcggcacguacgugagcgcgaucgcccaggccaaggccucccaggaggggccccuccccgagaucgaggacgagguguuccggaagcgcaaccugaccaucauggaccugcacccgggcagcgggaagacccggcgcuaccuccccgcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccuguccccggugcgcguccccaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccccagagcaacgccgucauccaggacgaggagcgggacauccccgagcgcuccuggaacagcggguacgaguggaucaccgacuuccccggcaagaccgugugguucgugccguccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccccgccggugccugaagcccgugauccugaaggacgggcccgagcgcgugauccucgccggcccgaugcccgucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucaucccggcccuguucgagcccgagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccgcucgcccugcgggaguucaaggaguucgccgcgggccgccggagcguguccggggaccugauccucgagaucggcaagcugccccagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugaucccggagcccgaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcacccggccuccgccuggacgcuguacgcgguggccaccaccaucaucacccccaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccgcucacgcugaccgccgcggugcugaugcucguggcccacuacgccaucaucggccccgggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccgcugaccacccucugggaggggucccccggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagccgauccccauggccaccuacggguggaaccucgucaagcugcacuccggcaaggacguguucuucaucccgcccgagaagugcgacacccugcucugcgacaucggggagagcuccccgaaccccacgaucgaggagggccgcacccugcgggugcugaagauggucgagcccuggcuccgcgggaaccaguucugcaucaagauccugaaccccuacaugccgagcgugguggagacccuggagcagaugcagcggaagcacggcggcaugcucguccgcaacccccugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaacccguacaagaccugggccuaccacggguccuacgaggugaagcccagcggcuccgcgagcagcauggucaacgggguggucaagcuccugaccaagcccugggacgugauccccauggugacccagaucgccaugacggacaccaccccguucggccagcagcgggucuucaaggagaagguggacacccgcacgcccaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagcccgagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagaccccgaaccucgccgagcgcgugcuggacuggcuggagaaguacggcguggagcggcucaagcgcauggccaucuccggggacgacugcgucgugaagcccaucgacgaccgguucgcgacggcccugaccgcccugaacgacaugggcaaggugcgcaaggacaucccccagugggagcccagcaagggguggaacgacuggcagcaggucccguucugcucccaccacuuccaccagcucaucaugaaggacggccgggagaucguggugcccugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaacccguggauggaggacaagacgcacaucagcuccuggggcgacguccccuaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8648 - RNA, 9879 nt, Artificial Sequence
  derived and/or modified CDS sequence (opt1) from DENV-1__GU131740__SS-prME
agcgugacgaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgugcccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgcuccaccagccuguccaugaccugcaucgccgucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucacguggaacgaccugauccggcugugcaucauggugggcgccaacgcguccgaccgcauggggaugggcaccaccuaccucgcccugauggccaccuucaagaugcgcccgauguucgccgugggccuccuguuccggcgccugacgagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacccuccuguccuucacguucaucaagaccaccuucagccugcacuacgccuggaagaccauggccauggugcucuccaucgugagccuguucccccugugccucuccacgaccagccagaagaccaccuggcugcccguccugcucggcucccuggggugcaagccgcugacgauguuccucaucgcggagaacaagguguggggccgcaagagcuggccccugaacgaggggaucauggccgugggcaucgucagcauccugcucuccagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacccuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacaccauguggcacgugacccggggcgccgugcugauguaccaggggaagcgccuggagcccuccugggcgagcgucaagaaggaccucaucuccuacggcggcggguggcggcugcagggcagcuggaacacgggggaggagguccaggugaucgccgucgagcccggcaagaaccccaagaacgugcagaccgcccccgggaccuucaagaccuccgagggcgaggugggcgccaucgcccuggacuucaagcccgggacgagcggcagccccaucgucaaccgcgaggggaagaucgugggccucuacggcaacgggguggucaccaccuccggcaccuacgugagcgcgaucgcccaggccaaggccucccaggaggggccccugccggagaucgaggacgagguguuccggaagcgcaaccugacgaucauggaccuccaccccggcagcgggaagacccggcgcuaccugcccgcgaucguccgggaggccaucaagcgcaagcugcggacccucauccuggccccgacccgcgugguggccuccgagauggccgaggcgcugaagggcaugcccauccgcuaccagacgaccgccgucaagagcgagcacaccggcaaggagaucguggaccucaugugccacgccaccuucacgaugcggcugcugucccccgugcgcguccccaacuacaacaugaucaucauggacgaggcccacuucaccgacccgagcuccaucgccgcgcggggguacaucagcacccgcgugggcaugggggaggccgccgccaucuucaugaccgccacgccgcccggcuccauggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccccgccggugccugaagccggucauccucaaggacgggcccgagcgcgugauccuggccggccccaugcccgucacgguggccuccgccgcccagcggcgcgggcggaucggccgcaaccacaacaaggagggcgaccaguacaucuacauggggcagccgcugaacaacgacgaggaccacgcgcacuggaccgaggccaagaugcuccuggacaacaucaacacccccgagggcaucauccccgcccuguucgagcccgagcgggagaaguccgccgccaucgacggggaguaccgccuccgcggcgaggcgcggaagaccuucguggagcugaugcgccgcggggaccugccggucuggcucagcuacaagguggccuccgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccccagcaccucacccagcgcgcccagaacgcccuggacaaccuggugaugcuccacaacagcgagcagggcgggcgggccuaccgccacgcgauggaggagcugccggacaccaucgagacgcugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagcccgaccgccagcggaccccgcaggacaaccagcucgccuacgucgugaucgggcugcuguucaugauccucacgguggccgccaacgagaugggccugcuggagaccaccaagaaggaccucgggaucggccacgcggccgucgagaaccaccaccacgccgccaugcuggacguggaccugcaccccgccuccgcguggacccucuacgccguggccacgaccaucaucacccccaugaugcgccacaccaucgagaacacgaccgccaacaucagccugaccgccaucgcgaaccaggccgccauccugauggggcucgacaagggcuggccgaucuccaagauggacaucggcgucccccugcuggcccucgggugcuacagccaggugaacccccugacccugacggcggccgugcucaugcuggucgcccacuacgccaucaucggccccgggcugcaggccaaggcgacccgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgccgugagcauggccaacaucuuccgggggagcuaccuggcgggcgccggccucgccuucucccugaugaagucccucgggggcgggcgccgggggaccggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagccggaggggaaggugaucgaccucggcugcggccgcggcggguggagcuacuacugcgccgggcugaagaaggugaccgaggucaagggguacacgaagggcgggcccggccacgaggagcccauccccauggccaccuacggguggaaccuggugaagcugcacuccggcaaggacguguucuucaucccgcccgagaagugcgacacccuccugugcgacaucggggagagcucccccaaccccaccaucgaggagggccgcacgcugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgguucacgauggcccaccgcaagccgaccuacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagcccgagcacgcgcugcuggccaaguccaucuucaagcucaccuaccagaacaaggugguccgcgugcagcggccggccaagaacgggaccgugauggacgucaucagccgccgcgaccagcggggcuccggccaggugggcaccuacggccugaacacguucaccaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugacggcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagaccgccugccugggcaaguccuacgcccagauguggcagcugauguacuuccaccggcgcgaccuccggcuggccgcgaacgccaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugacggcccgggcgaccugggccaccaacauccaggucgccaucaaccaggugcgccgccucaucggcaacgagaacuaccuggacuacaugaccuccaugaagcgguucaagaacgagagcgacccggagggggcccugugguga

SEQ ID NO: 8649 - RNA, 9879 nt, Artificial Sequence
  derived and/or modified CDS sequence (opt1) from DENV-1__GU131741__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcgggguguccaccagccaggagaccuggaaccggaaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccucgugcagaucaaguacgagggcaccgacgcgcccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcgucuucacguccguggggaagcuggugcaccagaucuucggcaccgccuacgggguccuguucagcggcguguccuggaccaugaagaucgggaucggcgugcuccugaccuggcugggccucaacagccgcuccacgagccuguccaugaccugcaucgccgucgggcuggugacccucuaccugggcgugaugguccaggccgacagcgggugcgugaucaacuggaagggccgggagcugaagugcgggagcggcaucuucgugaccaacgagguccacacguggaccgagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgccaacgcguccgaccgcauggggaugggcacgaccuaccucgcccugauggccaccuucaagaugcgcccgauguucgccguggggcuccuguuccggcgccugaccagccgggagguccugcuccugacgaucgggcugucccucguggccagcgucgagcugcccaacucccuggaggagcucggcgacgggcuggcgaugggcaucaugauccugaagcuccugaccgacuuccagagccaccagcugugggccacccuccugucccugaccuucaucaagacgaccuucagccuccacuacgccuggaagaccauggccauggugcuguccaucgugagccuguucccccucugccuguccaccacgagccagaagaccaccuggcugcccguccuccugggcucccuggggugcaagccgcucaccauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggacgaugaagaucaaggacgaggagcgggacgacacccugaccauccugcucaaggcgacccugcuggccgugagcggcgucuacccgcucuccauccccgccacccuguucgugugguacuucuggcagaagaagaagcagcgcagcggggugcugugggacacgcccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcccucgacuucaagcccgggaccagcggcagccccaucgugaaccgcgaggggaagaucgucggccuguacggcaacgggguggugacgaccuccggcaccuacgucagcgcgaucgcccaggccaaggccucccaggaggggccccugccggagaucgaggacgagguguuccggaagcgcaaccucaccaucauggaccugcaccccggcagcgggaagacgcggcgcuaccugcccgcgaucgugcgggaggccaucaagcgcaagcuccggacccugauccuggccccgacccgcgucguggccuccgagauggccgaggcgcucaagggcaugcccauccgcuaccagaccacggccgucaagagcgagcacaccggcaaggagaucgucgaccugaugugccacgccaccuucaccaugcggcugcucucccccgugcgcgugcccaacuacaacaugaucaucauggacgaggcccacuucacggacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccugcggaagaacgggaagcgcgugauccagcugucccggaagaccuucgacaccgaguaccagaagacgaagaacaacgacugggacuacgucgugaccaccgacaucagcgagaugggcgccaacuuccgcgcggaccgggugaucgacccccgccggugccucaagccggucauccugaaggacgggcccgagcgcgugauccuggccggccccaugcccgucaccguggccuccgccgcccagcggcgcgggcggaucggccgcaaccacaacaaggagggcgaccaguacaucuacauggggcagccgcucaacaacgacgaggaccacgcgcacuggacggaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacccucaugcugcuggcccucaucgccguccugacgggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagcccgaccgccagcggaccccgcaggacaaccagcuggccuacgucgugaucgggcuccucuucaugauccugaccguggccgccaacgagaugggccugcucgagacgaccaagaaggaccuggggaucggccacgucgcgguggagaaccaccaccacgccgccaugcuggacguggaccuccaccccgccuccgccuggacccuguacgcggucgccaccacgaucaucacccccaugaugcgccacaccaucgagaacaccacggccaacaucagccugaccgccaucgccaaccaggcggccauccucauggggcuggacaagggcuggccgaucuccaagauggacaucggcgugccccugcucgcccuggggugcuacagccaggugaacccccugacccucaccgccgcgguccugaugcugguggcccacuacgccaucaucggccccgggcuccaggccaaggccacgcgggaggcgcagaagcgcaccgccgccggcaucaugaagaacccgaccguggacgggaucgucgccaucgaccuggaccccgugguguacgacgccaaguucgagaagcagcugggccagaucaugcuccugauccugugcaccucccagauccuccugaugcgcacgaccugggcgcugugcgagagcaucacccucgccaccggcccccugacgacccugugggaggggucccccggcaaguucuggaacaccaccaucgccgucagcauggccaacaucuuccgggggagcuaccucgccggcgcgggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgcggugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcgggcccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgccgugaacaugaccucccgcaugcugcugaaccgguucaccauggcgcaccgcaagccgacguacgagcgcgacgucgaccucggggccggcacccggcacguggccguggagcccgaggucgccaaccuggacaucaucggccagcgcaucgagaacaucaagcacgagcacaagagcaccuggcacuacgacgaggacaaccccuacaagaccugggccuaccacggguccuacgaggugaagcccagcggcagcgcguccagcauggucaacgggguggugaagcugcucacgaagccgugggacgucauccccauggugacccagaucgccaugaccgacaccacgcccuucggccagcagcggguguucaaggagaaggucgacacccgcacccccaaggccaagcgggggaccgcccagaucauggaggugacggccaaguggcuguggggcuuccugucccgcaacaagaagccgcggaucugcacccgcgaggaguucacccggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcccugcucgcgaaguccaucuucaagcugacguaccagaacaaggucgugcgcgugcagcggccggccaagaacgggaccgucauggacgugaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccggguccucgacuggcuggagaagcacgggguggagcgccugaagcggauggccaucuccggcgacgacugcguggucaagcccaucgacgaccgcuucgcgaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgccggguggagccugcgcgagacggcgugccugggcaaguccuacgcccagauguggcagcucauguacuuccaccggcgcgaccugcggcuggccgccaacgcgaucugcagcgccgugccgguggacuggguccccaccucccgcaccaccuggagcauccacgcccaccaccaguggaugacgaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucaccgcccgggccacgugggcgaccaacauccagguggccaucaaccaggugcgccgccugaucggcaacgagaacuaccuggacuacaugaccuccaugaagcgguucaagaacgagagcgacccggagggggcccucugguga

SEQ ID NO: 8650 - RNA, 9879 nt, Artificial Sequence
  derived and/or modified CDS sequence (opt1) from DENV-1__GU131743__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugaccucccgcaugcugcucaaccgguucacgauggcccaccgcaagcccaccuacgagcgggacguggaccugggggccggcacccgccacgucgccguggagcccgagguggccaaccuggacgucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggugaagcuccugaccaagcccugggacgucauccccauggugacccagaucgccaugaccgacacgacccccuucggccagcagcgcguguucaaggagaaggucgacacccggaccccgaaggccaagcgcgggacggcccagaucauggaggugaccgcgaaguggcuguggggcuuccucucccggaacaagaagccccgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcugcacaagcaggggaagugcgccacgugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggucgugcgggugcagcgccccgccaagaacgggaccgucauggacgugaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcggguccuggacuggcugggcaaguacgggguggagcgccucaagcggauggcgaucuccggcgacgacugcguggucaagccgaucgacgaccgcuucgccaccgcccugacggcccugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgcgggguggagccugcgcgagaccgccugccucggcaaguccuacgcccagauguggcagcugauguacuuccaccggcgcgaccugcggcucgccgcgaacgccaucugcagcgccgugcccguggacuggauccccaccucccgcaccacguggagcauccacgcccaccaccaguggaugaccaccgaggacaugcuguccgucuggaaccgcguguggaucgaggagaaccccuggauggaggacaagacccacaucagcuccuggggcgacgugccguaccugggcaagcgggaggaccaguggugcggcagccucaucgggcugacggcccgcgcgaccugggccaccaacauccaggucgccaucaaccaggugcggcgccugaucggcaacgagaacuaccucgacuacaugaccuccaugaagcgguucaagaacgagagcgaccccgagggggcccugugguga

SEQ ID NO: 8651 - RNA, 9879 nt, Artificial Sequence
  derived and/or modified CDS sequence (opt1) from DENV-1__JN093516__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccacgcgcggggcccgccggauggccauccucggcgacaccgcgugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgcgagcugaagugcgggagcggcaucuucgugaccaacgaggugcacaccuggaccgagcaguacaaguuccaggccgacuccccgaagcggcucagcgcggccaucggcaaggccugggaggagggggucugcggcauccgcuccgccacccggcuggagaacaucauguggaagcagaucagcaacgagcugaaccacauccuccuggagaacgacaugaaguucacggugguggucggggacguggccggcauccuggcgcaggggaagaagaugauccgcccccagcccauggaguacaaguacuccuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcucaagcugcgcgacuccuacacccaggugugcgaccaccggcugaugagcgcggccaucaaggacuccaaggccgugcacgccgacaugggcuacuggaucgagagcgagaagaacgagaccuggaagcucgcccgcgcguccuucaucgaggucaagacgugcaucuggcccaagagccacacccugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcacgaccguggucguggacgagcacugcggcaaccgcgggccgagccugcggaccaccacggugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacgcucgccguguucuuccugcugaucauggggcagcucaccuggaacgaccugauccgccugugcaucauggucggcgccaacgcguccgaccggauggggaugggcaccaccuaccucgcccugauggccacguucaagaugcgcccgauguucgccguggggcuccuguuccgccggcugaccagccgcgaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacgcuccugucccugaccuucaucaagaccaccuucagccuccacuacgccuggaagacgauggccaugguccuguccaucgugagccuguucccccucugccuguccaccaccagccagaagaccacguggcugcccgugcuccugggcucccuggggugcaagccgcucaccauguuccugaucgcggagaacaagaucuggggccgcaagagcuggccccugaacgaggggaucauggccgucggcaucgugagcauccuccuguccagccugcucaagaacgacgugccccuggccgggccccugaucgccggcggcaugcucaucgccugcuacgucaucuccgggagcuccgcggaccugagccuggagaaggccgccgagguguccugggaggaggaggccgagcacagcggcgccucccacaacauccucguggagguccaggacgacgggaccaugaagaucaaggacgaggagcgcgacgacacccugaccauccugcucaaggcgacgcugcuggccgugagcggcguguacccgcucuccauccccgccacccuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacaccauguggcacgugacgcgcggcgccguccugauguaccaggggaagcggcucgagcccuccugggcgagcgugaagaaggaccugaucuccuacggcggcggguggcgccugcagggcagcuggaacaccggggaggaggugcaggucaucgccguggagcccggcaagaaccccaagaacgugcagaccgcccccgggaccuucaagacguccgagggcgaggucggcgccaucgcccucgacuucaagcccgggaccagcggcagccccaucgugaaccgggaggggaagaucgugggccuguacggcaacggggucgugaccaccuccggcacguacgugagcgcgaucgcccaggccaaggccucccaggaggggccccugccggagaucgaggacgaggucuuccgcaagcggaaccucaccaucauggaccugcaccccggcagcgggaagacccgccgguaccugcccgcgaucgugcgcgaggccaucaagcggaagcuccgcacccugauccuggccccgacgcggguggucgccuccgagauggccgaggcgcucaagggcaugcccauccgcuaccagaccaccgccgucaagagcgagcacaccggcaaggagaucguggaccugaugugccacgccacguucaccaugcgccugcucucccccguccgggugcccaacuacaacaugaucaucauggacgaggcccacuucaccgacccgagcuccaucgccgcgcgcggguacaucagcacccgggugggcaugggggaggccgccgccaucuucaugacggccacgccgcccggcuccgucgaggcguucccccagagcaacgccgugauccaggacgaggagcgcgacaucccggagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgccaacuuccgggcggaccgcgugaucgacccccggcgcugccucaagccggugauccugaaggacgggcccgagcgggucauccuggccggccccaugcccgugaccgucgccuccgccgcccagcgccgggggcgcaucggccggaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgcgagaaguccgccgccaucgacggggaguaccggcugcgcggcgaggcgcgcaagacguucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgccgcgggccggcgcagcgucuccggggaccugauccuggagaucggcaagcucccccagcaccugacccagcgggcccagaacgcccuggacaaccucgugaugcugcacaacagcgagcagggcgggcgcgccuaccggcacgcgauggaggagcugccggacacgaucgagacccucaugcugcuggcccucaucgccgugcugaccggcggggucacccuguucuuccucuccggccgcgggcugggcaagaccagcaucggccugcucugcgugauggccuccagcgcccugcuguggauggcguccguggagccccacuggaucgccgccagcaucauccucgaguucuuccugaugguccugcucauccccgagcccgaccggcagcgcacgccgcaggacaaccagcuggccuacguggugaucgggcuccucuucaugauccugaccgucgccgcgaacgagaugggccugcucgagaccaccaagaaggaccuggggaucggccacguggccguggagaaccaccaccacgccacgaugcuggacgucgaccuccaccccgccuccgccuggacccuguacgcgguggccaccaccaucaucacgcccaugaugcggcacaccaucgagaacaccaccgccaacaucagccugacggccaucgccaaccaggcggccauccucauggggcuggacaagggcuggccgaucuccaagauggacaucggcgugccccugcucgcccuggggugcuacagccaggucaacccccugacccucaccgccgcggugcugaugcugguggcccacuacgccaucaucggccccgggcuccaggccaaggccacccgcgaggcgcagaagcggacggccgccggcaucaugaagaacccgaccgucgacgggaucguggccaucgaccuggaccccguggucuacgacgccaaguucgagaagcagcugggccagaucaugcuccugauccugugcaccucccagauccuccugaugcgcaccacgugggcgcugugcgagagcaucacccucgccaccggcccccugaccacgcugugggaggggucccccggcaaguucuggaacaccaccaucgccgugagcauggccaacaucuuccgcgggagcuaccucgccggcgcgggccuggccuucucccugaugaagucccucgggggcgggcggcgcggcaccggggcccagggcgagacgcugggcgagaaguggaagcggcagcugaaccagcucuccaagagcgaguucaacaccuacaagcgcuccgggaucauggagguggaccggagcgaggccaaggagggccugaagcgcggggagaccaccaagcacgcggucucccggggcacggccaagcugcgcugguucguggagcggaaccucgugaagccggaggggaaggucaucgaccugggcugcggccgcgggggcuggagcuacuacugcgccgggcugaagaaggugaccgaggugaagggcuacaccaagggcgggcccggccacgaggagcccauccccauggccaccuacggguggaaccuggucaagcuccacuccggcaaggacguguucuucaucccgcccgagaagugcgacacgcugcugugcgacaucggggagagcucccccaaccccaccaucgaggagggccggacccuccgcgugcugaagauggucgagccguggcugcgggggaaccaguucugcaucaagauccucaaccccuacaugcccagcgugguggagacccuggagcagaugcagcgcaagcacggcggcaugcugguccggaacccccucucccgcaacagcacccacgagauguacuggguguccugcgggacgggcaacaucgugagcgccgucaacaugaccucccggaugcugcugaaccgcuucaccauggcgcaccggaagccgaccuacgagcgcgacguggaccucggggccggcacgcgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggugaagcccagcggcagcgcguccagcauggucaacgggguggucaagcugcucaccaagccgugggacgugauccccauggugacgcagaucgccaugaccgacaccacccccuucggccagcagcgcgucuucaaggagaagguggacacgcggacccccaaggccaagcgcgggaccgcccagaucauggaggugaccgccaaguggcuguggggcuuccugucccggaacaagaagccgcgcaucugcacgcgggaggaguucacccgcaagguccggagcaacgcggccaucggcgccguguucguggacgagaaccaguggaacuccgccaaggaggcggucgaggacgagcgcuucugggaccucgugcaccgggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccggggucgagggcgaggggcugcacaagcugggcuacauccuccgggacaucagcaagauccccgggggcaacauguacgccgacgacaccgccggcugggacacgcgcaucaccgaggacgaccugcagaacgaggccaagaucaccgacaucauggagcccgagcacgcccugcucgcgaaguccaucuucaagcugaccuaccagaacaagguggugcggguccagcgcccggccaagaacgggacggugauggacgugaucagccggcgcgaccagcgcggcuccgggcaggucggcaccuacggccugaacaccuucaccaacauggaggcccagcucauccggcagauggagagcgaggggaucuucucccccagcgagcuggagacgcccaaccuggccggccgcgugcucgacuggcuggagaagcacgggguggagcggcugaagcgcauggccaucuccggcgacgacugcgucgugaagcccaucgacgaccgguucgcgaccgcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcccgcgugucccagggcgccggguggagccugcgggagaccgcgugccugggcaaguccuacgcccagauguggcagcucauguacuuccaccgccgggaccugcgccuggccgccaacgcgaucugcagcgccgugccggucgagugggugcccacgucccggaccaccuggagcauccacgcccaccaccaguggaugaccacggaggacaugcucuccguguggaaccgcgucuggaucgaggagaaccccuggauggaggacaagacccacaucagcuccuggggcgacgugcccuaccugggcaagcgggaggaccaguggugcggcagccugaucgggcucaccgcccgcgccaccugggcgaccaacauccagguggccaucaaccagguccggcgccugaucggcaacgagaacuaccuggacuacaugacguccaugaagcgcuucaagaacgagagcgacccggagggggcccucugguga

SEQ ID NO: 8652 - RNA, 9879 nt, Artificial Sequence
  derived and/or modified CDS sequence (opt1) from DENV-1__GU131746__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagaaggcccagaacgcccuggacaaccuggugaugcuccacaacagcgagcagggcgggcgcgccuaccggcacgcgauggaggagcugcccgacacgaucgagacccugaugcuccuggcccugaucgccguccucaccggcggggugacccuguucuuccuguccggccgcgggcucggcaagaccagcaucggccugcugugcgugauggccuccagcguccuccuguggauggccuccguggagccccacuggaucgcggccagcaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcggcacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcgcaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcggaccaccugggcgcugugcgagagcaucacgcuggccaccggcccccucaccacccugugggagggguccccgggcaaguucuggaacacgaccaucgccgucagcauggccaacaucuuccgcggguccuaccuggccggcgcgggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggccaaggagggccucaagcgcggggagaccaccaagcacgcggugucccggggcaccgccaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgccgugaacaugacgucccggaugcuccugaaccgcuucaccauggcgcaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcugaccaagcccugggacgucauccccauggugacccagaucgccaugacggacaccacccccuucggccagcagcgcguguucaaggagaaggucgacacccggacgccgaaggccaagcgcgggaccgcccagaucauggaggugaccgccaaguggcucuggggcuuccugucccggaacaagaagccccgcaucugcacccgggaggaguucacgcgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucacggaggacgaccuccagaacgaggcccggaucaccgacaucauggagccggagcacgcccugcuggcgaaguccaucuucaagcucaccuaccagaacaaggucgugcgcgugcagcgccccgccaagaacgggaccgucauggacgugaucagccggcgcgaccagcggggcuccggccagguggggacguacggccugaacaccuucaccaacauggaggcccagcugauccgccagauggagagcgaggggaucuucucccccagcgagcucgagacccccaaccuggccgagcggguccuggacuggcucgagaaguacggcguggagcgccugaagcggauggccaucuccggggacgacugcguggucaagccgaucgacgaccgcuucgcgacggcccugaccgcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggccggcuggagccuccgcgagaccgcgugccuggggaaguccuacgcccagauguggcagcugauguacuuccaccggcgcgaccuccggcuggccgccaacgcgaucugcagcgccgugcccguggacuggauccccaccucccgcacgaccuggagcauccacgcccaccaccaguggaugaccaccgaggacaugcuguccgucuggaaccggguguggaucgaggagaaccccuggauggaggacaagacgcacaucagcuccuggggcgacgugccguaccucgggaagcgcgaggaccaguggugcggcagccugaucggccugaccgcccgcgccaccugggcgaccaacauccaggucgccaucaaccaggugcggcgccucaucgggaacgagaacuaccuggacuacaugaccuccaugaagcgguucaagaacgagagcgaccccgagggcgcccugugguga

SEQ ID NO: 8653 - RNA, 9879 nt, Artificial Sequence
  derived and/or modified CDS sequence (opt1) from DENV-1__JF937609__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacgcucauccuggcccccacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccucaaggacgggcccgagcgcgugauccuggcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggucaugcuccacaacagcgagcagggcgggcgggccuaccgccacgccauggaggagcugcccgacaccaucgagacccugaugcuccuggcgcugaucgccgugcucaccggcggggugacccuguucuuccuguccggccgggggcucggcaagacgagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcggacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcacggggaacaucgugagcgccgucaacaugaccucccgcaugcuccugaaccgcuucaccauggcccaccggaagcccaccuacgagcgcgacguggaccugggcgcgggcacgcggcacguggccgucgagcccgagguggccaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgggucuucaaggagaagguggacacgcgcaccccgaaggccaagcggggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggcccgcuccaucuucaagcucaccuaccagaacaagguggugcggguccagcgccccgcgaagaacggcacggugauggacgugaucagccggcgcgaccagcggggguccggccaggucggcaccuacgggcugaacaccuucaccaacauggaggcccagcugauccgccagauggagagcgagggcaucuucucccccagcgagcucgagacgcccaaccuggccgagcgggugcuggacuggcucgagaaguacgggguggagcgccugaagcggauggccaucuccggcgacgacugcgucgugaagccgaucgacgaccgcuucgccaccgcgcugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgccggguggagccuccgcgagaccgccugccugggcaaguccuacgcgcagauguggcagcugauguacuuccaccggcgcgaccuccggcuggccgccaacgccaucugcagcgcggugcccgucgacuggauccccacgucccgcaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgggaggaccaguggugcggcagccugaucgggcugaccgcccgcgccaccugggccaccaacauccagguggcgaucaaccaggugcggcgccucaucggcaacgagaacuaccuggacuacaugacguccaugaagcgguucaagaacgagagcgaccccgagggggcccugugguga

SEQ ID NO: 8654 - RNA, 9879 nt, Artificial Sequence
  derived and/or modified CDS sequence (opt1) from DENV-1__KF921949__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguuccgcaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacgugaccggcauccucgcccaggggaagaagaugauccgcccccagcccauggaguacaaguacagcuggaaguccuggggcaaggcgaagaucaucggcgccgacgugcagaacaccaccuucaucaucgacgggcccaacacgccggagugccccgacgaccagcgggccuggaacaucugggaggucgaggacuacggcuucgggaucuucaccaccaacaucuggcugaagcugcgcgacagcuacacccaggugugcgaccaccggcucauguccgccgcgaucaaggacagcaaggccgugcacgccgacaugggcuacuggaucgaguccgagaagaacgagacguggaagcuggcccgcgccagcuucaucgaggucaagaccugcaucuggcccaagucccacacccuguggagcaacggcgugcucgaguccgagaugaucauccccaagaucuacgggggcccgaucagccagcacaacuaccggcccggguacuucacccagacggcgggccccuggcaccuggggaagcuggagcucgacuucgaccugugcgagggcaccaccguggucguggacgagcacugcggcaaccgcgggccgucccugcggaccacgaccgugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugacgggcacccuggccguguuccugcuccugaucauggggcagcugaccuggaacgaccucauccgccugugcaucauggucggcgccaacgccagcgaccggauggggaugggcaccacguaccuggcgcucauggccaccuucaagaugcgcccgauguucgccgugggccugcuguuccggcgccucaccucccgggaggugcugcugcucaccaucgggcugagccuggucgccuccguggagcuccccaacagccuggaggagcugggcgacgggcucgccaugggcaucaugauccugaagcugcucacggacuuccagucccaccagcugugggcgacccugcucagccugaccuucaucaagaccacguucucccugcacuacgccuggaagaccauggccaugguccucagcaucgugucccuguucccccugugccucagcaccaccucccagaagacgaccuggcugcccgugcugcucggcagccuggggugcaagccgcugaccauguuccucaucgccgagaacaagaucuggggccgccgguccuggccccugaacgaggggaucauggcggucggcaucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggaccaugaagaucaaggacgaggagcgcgacgacacccucacgauccugcugaaggccacccuccuggcgguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacacgauguggcacgugacccgcggcgccguccugauguaccaggggaagcggcuggagcccagcugggccuccgugaagaaggaccucaucagcuacggcggcggguggcgccugcagggcuccuggaacaccggggaggaggugcaggucaucgcgguggagcccggcaagaaccccaagaacgugcagaccgcccccgggacguucaagacccccgagggcgaggucggcgccaucgcccuggacuucaagcccgggaccagcggcucccccaucgugaaccgggaggggaagaucgugggccucuacggcaacggggucgugaccacgagcggcaccuacgugagcgccaucgcgcaggccaaggccucccaggaggggccgcugcccgagaucgaggacgaggucuuccgcaagcggaaccugaccaucauggaccuccaccccggcagcgggaagacccgccgguaccugccggccaucgugcgcgaggcgaucaagcgcaagcugcggacgcucauccuggcccccacccgcguggucgccuccgagauggccgaggcccugaagggcaugcccauccgguaccagaccaccgcggucaagagcgagcacacgggcaaggagaucguggaccucaugugccacgccaccuucaccaugcgccugcugucccccguccgggugccgaacuacaacaugaucaucauggacgaggcccacuucaccgaccccagcuccaucgccgcccgcggguacaucagcacgcgggugggcaugggggaggcggccgccaucuucaugaccgccacgccgcccggcuccgucgaggccuucccgcagagcaacgcggugauccaggacgaggagcgcgacauccccgagcgguccuggaacagcggguacgaguggaucaccgacuuccccggcaagacggugugguucguccccuccaucaagagcggcaacgacaucgccaacugccuccgcaagaacgggaagcgggugauccagcugucccgcaagaccuucgacaccgaguaccagaagaccaagaacaacgacugggacuacguggucacgaccgacaucagcgagaugggcgccaacuuccgggccgaccgcgugaucgacccgcggcgcugccugaagcccgugauccucaaggacgggcccgagcgggucauccuggcgggccccaugccggugaccgucgccuccgccgcccagcgccgggggcgcaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgggagaaguccgccgccaucgacggggaguaccgccuccggggcgaggcccgcaagaccuucguggagcugaugcggcgcggggaccugcccguguggcucuccuacaaggucgcgagcgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacuccgacccccuggcccugcgcgaguucaaggaguucgccgccggccggcgcagcgucuccggggaccucauccuggagaucggcaagcugccgcagcaccucacgcagcgggcgcagaacgcccuggacaaccuggugaugcuccacaacagcgagcagggcgggcgcgccuaccggcacgccauggaggagcugcccgacaccaucgagacccugaugcuccuggcgcugaucgccgugcucaccggcggggucacccuguucuuccuguccggccgcgggcucggcaagacgagcaucggccugcugugcgugauggccuccagcgugcuccuguggauggccuccgucgagccccacuggaucgccgcgagcaucauccuggaguucuuccucauggugcugcugauccccgagccggaccggcagcgcacgccccaggacaaccagcucgccuacguggucaucgggcugcuguucaugauccucaccguggccgccaacgagaugggccugcuggagaccacgaagaaggaccucgggaucggccacguggccgucgagaaccaccaccacgcggccaugcuggacguggaccugcaccccgccuccgccuggacccucuacgccguggcgaccaccaucaucacgccgaugaugcgccacaccaucgagaacaccaccgccaacaucagccugacggccaucgccaaccaggccgcgauccugauggggcucgacaagggcuggcccaucuccaagauggacaucggcgucccccugcuggcccucgggugcuacagccaggugaacccccugacccugaccgccgccgugcucaugcuggucgcgcacuacgccaucaucggcccggggcugcaggccaaggccacccgggaggcccagaagcgcacggcggccggcaucaugaagaaccccaccguggacgggaucguggccaucgaccucgaccccgucguguacgacgccaaguucgagaagcagcugggccagaucaugcugcucauccugugcaccucccagauccugcucaugcggaccacgugggcccugugcgagagcaucacccuggcgaccggcccccucaccacgcugugggagggguccccgggcaaguucuggaacaccaccaucgccgugagcauggccaacaucuuccgcggguccuaccuggccggcgccggccucgcguucagccugaugaagucccucgggggcgggcggcgcgggaccggggcccagggcgagacgcucggcgagaaguggaagcggcagcugaaccagcuguccaagagcgaguucaacaccuacaagcgcuccgggaucauggaggucgaccggagcgaggccaaggagggccucaagcgcggggagaccaccaagcacgccgugucccggggcacggcgaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccaccuacggguggaaccuggugaagcugcacuccggcaaggacguguucuucaucccgcccgagaagugcgacacgcuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggacgggcaacaucgucagcgccgugaacaugaccucccgcaugcuccugaaccgguucaccauggcccaccgcaagcccaccuacgagcgggacguggaccugggggcgggcacgcgccacgucgccguggagcccgagguggccaaccucgacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcugaccaagcccugggacgugauccccauggucacgcagaucgcgaugaccgacaccacccccuucggccagcagcgcguguucaaggagaagguggacacgcggaccccgaaggccaagcgcgggaccgcccagaucauggaggucaccgccaaguggcucuggggcuuccugucccggaacaagaagccccgcaucugcacgcgggaggaguucaccaagaaggugcgcagcaacgccgcgaucggcgccguguucgucgacgagaaccaguggaacuccgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgcggacgacaccgccggcugggacacgcggaucaccgaggacgaccuccagaacgaggcccgcaucaccgacaucauggagccggagcacgcccugcuggccaaguccaucuucaagcucaccuaccagaacaaggugguccgcgugcagcggcccgcgaagaacgggacggugauggacgucaucagccgccgggaccagcgcggcuccggccaggugggcaccuacggccugaacaccuucaccaacauggaggcccagcugauccggcagauggagagcgaggggaucuucucccccagcgagcucgagacgcccaaccuggccgagcgcgugcuggacuggcucgagaaguacggcgucgagcggcugaagcgcauggccaucuccggggacgacugcguggugaagccgaucgacgaccgguucgccaccgcgcugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgccugccuggggaaguccuacgcgcagauguggcagcugauguacuuccaccgccgggaccuccgccuggccgccaacgccaucugcagcgcgguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccucgggaagcgcgaggaccaguggugcggcagccugaucggccugaccgcccgggccaccugggccaccaacauccagguggcgaucaaccagguccgccggcucaucgggaacgagaacuaccuggacuacaugacguccaugaagcgcuucaagaacgagagcgaccccgagggcgcccugugguga

SEQ ID NO: 8655 - RNA, 9879 nt, Artificial Sequence
  derived and/or modified CDS sequence (opt1) from DENV-1__GU131747__SS-prME
agcgugaccaugcugcugaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcgccgggaagcucgugcaccagaucuucggcaccgccuacgggguccuguucuccggcgugagcuggacgaugaagaucgggaucggcgugcugcucaccuggcugggccugaacucccgcagcaccucccucagcaugaccugcaucgccgucgggcuggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucacgguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggugugcgaccaccgccugauguccgccgccaucaaggacagccgggccguccacgccgacaugggcuacuggaucgaguccgagaagaacgagaccuggaagcuggcgcgcgccagcuucaucgaggugaagacgugcaucuggcccaagucccacacccucuggagcaacggcgugcuggaguccgagaugaucauccccaagaucuacgggggcccgaucagccagcacaacuaccggcccggguacuucacccagaccgccggccccuggcaccuggggaagcucgagcuggacuucgaccugugcgagggcacgaccgucgugguggacgagcacugcggcaaccgcgggccgucccuccggaccaccacggucaccggcaagaucauccacgaguggugcugccgcagcugcacccugccgccccugcgguuccgcggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacgcuggccgucuucuuccuccugaucauggggcagcugaccuggaacgaccucauccgccugugcaucauggugggcgcgaacgccagcgaccggauggggaugggcaccaccuaccuggcccucauggccacguucaagaugcgcccgauguucgccgugggccugcuguuccggcgccucaccucccgggagguccugcugcucaccaucgggcugagccugguggcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgucuuccugggcagccucgggugcaagccgcugaccauguuccugaucgccgagaacaagaucuggggccgccgguccuggccccucaacgaggggaucauggccgugggcaucgugagcauccugcugagcucccuccugaagaacgacgucccccuggccgggccccucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggaccaugaagaucaaggacgaggagcgcgacgacacccugaccgugcuccugaaggccacgcugcucgccgucuccggcguguacccgcugagcauccccgccacccuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacgcgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcuccccgagaucgaggacgagguguuccgcaagcggaaccugaccaucauggaccugcaccccggcagcgggaagacccgccgguaccucccggccaucguccgcgaggccaucaagcgcaagcugcggacccugauccucgcccccacgcgcgugguggccuccgagauggcggaggcccugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgcgaacuuccgggccgaccgcgucaucgacccgcggcgcugccugaagcccgugauccugaaggacgggcccgagcgggugauccucgccggccccaugccggucaccguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgccgcgaacgagaugggccuccuggagaccaccaagaaggaccuggggaucggccacguggccguggagaaccaccaccacgccgccaugcucgacgucgaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggucaacccccucacgcugaccgcggccgugcugaugcucguggcccacuacgccaucaucggcccggggcugcaggccaaggcgacccgggaggcccagaagcgcaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggcgaaggagggccugaagcgcggggagaccaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugacgucccgcaugcugcucaaccgguucaccauggcccaccgcaagcccaccuacgagcgggacguggaccugggggccggcacccgccacguggccgucgagcccgagguggccaaccuggacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcuccugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgaaguggcuguggggcuuccucucccggaacaagaagccccgcaucugcacccgggaggaguucacgcgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcgcuccuggccaaguccaucuucaagcugaccuaccagaacaagguggugcggguccagcgccccgccaagaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaagcacggcguggagcgccucaagcggauggcgaucuccggggacgacugcgucgugaagccgaucgacgaccgcuucgccacggcccugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccgugcccgucgacuggauccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgggaggaccaguggugcggcagccucaucggccugaccgcccgcgcgaccugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8656 - RNA, 9879 nt, Artificial Sequence
  derived and/or modified CDS sequence (opt1) from DENV-1__GU131748__SS-prME
agcgugaccaugcuguucaugcucgugcccaccgcccuggccuuccaccugaccacccggggcggggagccccacaugaucgugagcaagcaggagcggggcaagagccuccuguucaagaccagcgccggggugaacaugugcacccugaucgccauggaccucggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccuggcgccccacgucggccucgggcuggagacccgcaccgagaccuggaugagcuccgagggcgccuggaagcagauccagcggguggagacgugggcccugcggcaccccggguucaccgugaucgcccucuuccuggcccacgcgaucggcaccagcaucacccagaaggggaucaucuucauccugcucaugcuggucacgcccuccauggccaugcggugcgugggcaucggcagccgcgacuucguggaggggcuguccggcgccaccugggucgacguggugcucgagcacgggagcugcgucaccaccauggccaaggacaagcccacgcuggacaucgagcugcucaagaccgaggugaccaaccccgccgugcugcggaagcugugcaucgaggcgaagaucuccaacaccacgaccgacagccgcugcccgacccagggcgaggccacccucgucgaggagcaggacgccaacuucgugugccggcgcacguucguggaccggggcugggggaacggcugcgggcuguucggcaaggggucccugaucacgugcgccaaguucaagugcgucaccaagcucgagggcaagaucgugcaguacgagaaccugaaguacagcgugaucgucaccgugcacacgggcgaccagcaccaggucgggaacgaguccaccgagcacggcaccaccgccaccaucacgccccaggcgcccaccaccgagauccagcugaccgacuacggggcccucacgcuggacugcagcccccgcaccggccuggacuucaacgagauggugcuccugaccaugaaggagaaguccuggcuggugcacaagcagugguuccucgaccugccccugcccuggaccagcggggccagcacgucccaggagaccuggaaccggcaggaccuccuggucaccuucaagaccgcccacgccaagaagcaggagguggugguccugggcagccaggagggcgcgaugcacacggcccucaccggggccaccgagauccagaccuccggcacgaccaccaucuucgccgggcaccugaagugccgccugaagauggacaagcucacccugaagggcaugagcuacgugaugugcacgggguccuucaagcuggagaaggagguggccgagacccagcacggcaccguccucgugcagaucaaguacgagggcaccgacgcgcccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcgucuucaccagcguggggaagcuggugcaccagaucuucggcaccgccuacgggguccuguucuccggcgugagcuggacgaugaagaucgggaucggcgugcuccugaccuggcugggccucaacucccgcagcaccucccugagcaugaccugcaucgccgucgggcuggugacgcucuaccugggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacgguggucgugggggacguggccggcauccuggcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgucgugguggacgagcacugcggcaaccgggggccgucccugcgcaccaccacggucaccggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacgcucgccgucuucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgugggccuccuguuccgccggcugaccucccgcgagguccugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccauggugcugagcaucgugucccuguucccccucugccugagcaccaccucccagaagaccacguggcugcccguccuccugggcagccuggggugcaagccgcucaccauguuccugaucgcggagaacaagaucuggggccggcgcuccuggccccugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacgcugcuggccguguccggcgucuacccgcucagcauccccgccacccuguucguguggcacuucuggcagaagaagaagcagcgcuccggggugcugugggacacccccagcccgcccgaggucgagcgggccgugcucgacgacggcaucuaccgcaucaugcagcggggccugcuggggcgcucccaggugggcgucgggguguuccaggagaacguguuccacaccauguggcacgucacgcggggcgccgugcugauguaccaggggaagcgccucgagcccagcugggcguccgugaagaaggaccugaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucgugcgggaggccaucaagcgcaagcuccgcacccugauccuggcccccacgcgggucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccucaagcccgucauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgcgaggcgcagaagcggaccgccgccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgucagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggugucccgcggcaccgccaagcugcggugguucgucgagcgcaaccucgugaagcccgaggggaaggugaucgaccugggcugcggccgcggcggguggagcuacuacugcgccgggcugaagaaggucacggaggugaagggguacaccaagggcggccccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccgcacccuccgggugcugaagaugguggagcccuggcugcgcgggaaccaguucugcaucaagauccucaaccccuacaugcccagcgucguggagacccuggagcagaugcagcggaagcacggcggcaugcuggugcgcaacccgcucucccggaacagcacccacgagauguacugggucuccugcgggaccggcaacaucgugagcgccgugaacaugacgucccgcaugcugcugaaccgcuucaccauggcgcaccggaagcccaccuacgagcgcgacgucgaccucggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcucaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcucauccggcagauggagagcgaggggaucuucucccccagcgagcuggagacccccaaccuggccgagcgcguccucgacuggcuggagaaguacggcgugaagcggcugaagcgcauggccaucuccggggacgacugcguggucaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagaccgcgugccuggggaaguccuacgcccagauguggcagcucauguacuuccaccgccgggaccugcgccuggccgccaacgcgaucugcagcgccgugcccguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccuggggaagcgcgaggaccaguggugcggcagccugaucggccucaccgcccgggccaccugggcgaccaacauccaggucgccaucaaccaggugcgccggcugaucgggaacgagaacuaccuggacuacaugaccuccaugaagcgcuucaagaacgagagcgaccccgagggcgcccucugguga

SEQ ID NO: 8657 - RNA, 9879 nt, Artificial Sequence
  derived and/or modified CDS sequence (opt1) from DENV-1__GQ868615__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcguggagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8658 - RNA, 9879 nt, Artificial Sequence
  derived and/or modified CDS sequence (opt1) from DENV-1__GU131749__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuaccgcgugcuguucuccggggucagcuggaccaugaagaucggcaucggggugcugcucacguggcugggccugaacucccggagcaccucccucagcaugaccugcaucgccgugggccuggucacccuguaccucggggugauggugcaggccgacuccggcugcgucaucaacuggaaggggcgcgagcugaagugcggcagcgggaucuucgugacgaacgaggugcacaccuggaccgagcaguacaaguuccaggcggacagcccgaagcggcuguccgccgccaucggcaaggccugggaggagggcgucugcgggauccgcagcgccacccggcucgagaacaucauguggaagcagaucuccaacgagcugaaccacauccugcucgagaacgacaugaaguucaccgugguggucggcgacguggcggggauccuggugcagggcaagaagaugauccgcccccagcccauggaguacaaguacagcuggaaguccugggggaaggccaagaucaucggcgccgacguccagaacagcacguucaucaucgacggccccaacaccccggagugccccgacgaccagcgggccuggaacaucugggagguggaggacuacggguucggcaucuucaccaccaacaucuggcugaagcuccgcgacuccuacacccaggugugcgaccaccggcugaugagcgcggccaucaaggacuccaaggccguccacgccgacaugggguacuggaucgagagcgagaagaacgagaccuggaagcuggcccgcgcguccuucaucgaggugaagaccugcaucuggcccaagagccacacccucugguccaacggcgugcuggagagcgagaugaucauccccaagauccacggcgggccgaucucccagcacaacuaccggcccggcuacuucacgcagaccgccgggcccuggcaccugggcaagcucgagcuggacuucgaccugugcgaggggaccaccgucgugguggacgagcacugcggcaaccgcggcccgagccuccggacgaccaccgucaccgggaagaucauccacgaguggugcugccgcuccugcacgcugccgccccugcgguuccgcggcgaggacgggugcugguacggcauggagauccggcccgugaaggagaaggaggagaaccucgugaaguccauggucagcgccggguccggcgagguggacagcuucucccugggccugcucugcaucagcaucaugaucgaggaggugaugcgcucccgguggagccgcaagaugcugaugaccgggacccuggccgucuucuuccuccugaucaugggccagcugaccuggaacgaccucauccgccugugcaucauggugggggccaacgcguccgaccggaugggcauggggacgaccuaccuggcccucauggccaccuucaagaugcgcccgauguucgccgugggccugcuguuccggcgccucaccagccgggagguccugcugcucacgaucggccugucccugguggccagcgucgagcuccccaacucccuggaggagcugggggacggccucgcgauggggaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucggcucccugggcugcaagccgcugaccauguuccucaucgcggagaacaagaucugggggcgcaagagcuggccccugaacgagggcaucauggccguggggaucgugagcauccugcucuccagccugcugaagaacgacgucccccucgccggcccccugaucgccgggggcaugcugaucgccugcuacgugaucuccggcagcuccgcggaccucagccuggagaaggccgccgagguguccugggaggaggaggccgagcacagcggggccucccacaacauccuggucgaggugcaggacgacggcacgaugaagaucaaggacgaggagcgggacgacacccucaccauccugcugaaggcgacccuccuggccgugagcggggucuacccgcuguccauccccgccacccucuucguguggcacuucuggcagaagaagaagcagcgcagcggcgugcugugggacacgcccagcccgcccgaggucgagcgggccgugcuggacgacgggaucuaccgcaucaugcagcggggccugcucggccgcagccaggugggggucggcguguuccaggagaacguguuccacaccauguggcacgucacccgcggggccgugcugauguaccagggcaagcgccuggagcccuccugggcgagcgugaagaaggaccucaucuccuacgggggcggcuggcgguuccaggggagcuggaacaccggcgaggagguccaggugaucgccguggagcccgggaagaaccccaagaacguccagacggcccccggcaccuucaagacccccgagggggaggugggcgccaucgcccuggacuucaagcccggcaccuccgggagccccaucgugaaccgcgagggcaagaucgucgggcuguacggcaacggcguggugacgaccagcgggaccuacgucuccgcgaucgcccaggccaaggccagccaggagggcccgcuccccgagaucgaggacgagguguuccggaagcgcaaccugaccaucauggaccugcaccccggguccggcaagacgcggcgcuaccucccggcgaucgugcgggaggccaucaagcgcaagcugcgcacccugauccucgcccccacccgggucguggccagcgagauggccgaggcgcugaaggggaugcccauccgcuaccagaccacggccgugaaguccgagcacaccggcaaggagaucgucgaccugaugugccacgccaccuucaccaugcggcuccugagccccgugcgcgugccgaacuacaacaugaucaucauggacgaggcccacuucacggaccccuccagcaucgccgcgcggggcuacaucuccacccgcgucgggaugggcgaggccgccgccaucuucaugaccgccacgccgcccgggagcauggaggcguucccgcaguccaacgccgugauccaggacgaggagcgggacauccccgagcgcagcuggaacuccggcuacgaguggaucacggacuuccccgggaagaccgugugguucguccccagcaucaaggccggcaacgacaucgccaacugccugcggaagaacggcaagcgcgugauccagcucucccggaagaccuucgacaccgaguaccagaagacgaagaacaacgacugggacuacguggucaccaccgacaucagcgagaugggggcgaacuuccgcgccgaccgggugaucgacccgcgccggugccugaagcccgugauccugaaggacggccccgagcgcgucauccucgccgggcccaugccggugaccgucgccuccgccgcgcagcggcgcggccggaucgggcgcaaccacaacaaggagggcgaccaguacaucuacaugggccagccccugaacaacgacgaggaccacgcccacuggacggaggccaagaugcugcucgacaacaucaacacccccgaggggaucauccccgcccuguucgagccggagcgcgagaaguccgccgcgaucgacggcgaguaccggcugcgcggggaggcccggaagaccuucguggagcucaugcgccggggcgaccugcccguguggcuguccuacaaggucgccagcgagggguuccaguacagcgaccgccgguggugcuucgacggcgagcgcaacaaccaggugcucgaggagaacauggacguggagaucuggaccaaggagggcgagcggaagaagcugcgcccccgguggcuggacgcccgcacguacuccgacccccucgcccugcgggaguucaaggaguucgcggccgggcgccggagcgucuccggcgaccugauccucgagaucgggaagcugccgcagcaccugacccagcgcgcccagaacgcccucgacaaccuggugaugcugcacaacagcgagcagggcggccgggcguaccgccacgccauggaggagcuccccgacaccaucgagacccugaugcugcucgcccugaucgccgugcugaccggcggggucacccucuucuuccuguccgggaaggggcuggggaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucggccuccuguucaugauccugaccguggccgcgaacgagauggggcuccuggagacgaccaagaaggaccugggcaucgggcacguggccgucgagaaccaccaccacgccgccaugcucgacguggaccugcaccccgccuccgcguggacccuguacgccguggccaccacgaucaucaccccgaugaugcggcacaccaucgagaacaccacggccaacaucagccucaccgccaucgcgaaccaggccgccauccugaugggccuggacaagggguggcccaucuccaagauggacaucggcgucccccuccuggcccugggcugcuacagccaggugaacccccucacccugaccgcggccgugcugaugcucgucgcccacuacgccaucaucgggccgggccugcaggccaaggcgacgcgcgaggcccagaagcgcaccgccgccgggaucaugaagaaccccaccaucgacggcaucguggccaucgaccuggaccccguggucuacgacgcgaaguucgagaagcagcucgggcagaucaugcugcugauccucugcaccucccagauccugcugaugcggacgaccugggcccucugcgagagcaucacccuggccaccggcccccugacgacccucugggagggcuccccggggaaguucuggaacaccaccaucgccgugagcauggccaacaucuuccgcggcuccuaccuggcgggggccggccuggccuucagccucaugaagucccugggcgggggccggcgcgggacgggcgcccagggggagacccugggcgagaaguggaagcggcagcucaaccagcuguccaagagcgaguucaacaccuacaagcgcuccggcaucauggagguggaccggagcgaggcgaaggaggggcugaagcgcggcgagaccacgaagcacgccgucucccgggggaccgccaagcuccgcugguucguggagcggaaccuggugaagcccgagggcaaggucaucgaccuggggugcggccgcggcggguggagcuacuacugcgccggccugaagaaggugaccgaggugaagggguacaccaagggcgggcccggccacgaggagcccaucccgauggccacguacggcuggaaccucgucaagcugcacuccgggaaggacguguucuucaucccgcccgagaagugcgacacccugcucugcgacaucggcgagagcucccccaacccgaccaucgaggaggggcggacccugcgcgugcugaagauggucgagcccuggcuccggggcaaccaguucugcaucaagauccugaaccccuacaugcccagcgugguggagacgcuggagcagaugcagcgcaagcacgggggcaugcucguccggaacccgcugucccgcaacagcacccacgagauguacuggguguccugcggcaccgggaacaucgugagcgcgaucaacaugaccucccggaugcugcucaaccgcuucaccauggcccaccgcaagcccacguacgagcgggacgucgaccugggcgccgggacccgccacguggccguggagcccgaggucgccaaccuggacaucaucggccagcggaucgagaacaucaagcacgagcacaagagcaccuggcacuacgacgaggacaaccccuacaagaccugggcguaccacggcuccuacgaggugaagccgagcggguccgccagcagcauggugaacggcgucgugaagcuccugacgaagcccugggacgucauccccauggugacccagaucgccaugaccgacaccacgcccuucgggcagcagcgcguguucaaggagaaggucgacacccggaccccgaaggccaagcgcggcaccgcccagaucauggaggugacggcgcgguggcuguggggguuccucucccgcaacaagaagccccggaucugcacccgcgaggaguucacccggaaggugcgcagcaacgccgccaucggcgccgucuucguggacgagaaccaguggaacuccgcgaaggaggccguggaggacgaccgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggggcgcgcuuccuggaguucgaggcccucggcuucaugaacgaggaccacugguucucccgggagaacagccuguccggcguggagggggagggccugcacaagcucggguacauccugcgcgacaucagcaagauccccggcgggaacauguacgccgacgacacggccggcugggacacccggaucaccgaggacgaccugcagaacgaggccaagaucaccgacaucauggagccggagcacgcgcuccuggccaaguccaucuucaagcugacguaccagaacaaggucgugcgcgugcagcgccccgccaagaacggcaccgucauggacgugaucagccggcgcgaccagcggggguccggccagguggggaccuacggccucaacaccuucacgaacauggaggcccagcugauccgccagauggagagcgagggcaucuuccugcccaacgagcucgagacccccaaccuggccgggcggguccuggacuggcucgagaaguacggcguggagcgccugaagcggauggcgaucuccggggacgacugcguggucaagccgaucgacgaccgcuucgccaccgcccugaccgcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggcgggcuggucccuccgcgagacggccugccugggcaagagcuacgcccagauguggcagcugauguacuuccaccggcgcgaccuccggcuggccgcgaacgccaucugcagcgccgugcccguggacuggguccccaccucccgcaccaccuggagcauccacgcccaccaccaguggaugacgaccgaggacaugcuguccguguggaaccggguguggaucgaggagaaccccuggauggaggacaagacccgcaucagcuccugggaggacgucccguaccucggcaagcgcgaggaccaguggugcgggagccugaucggccugaccgcccgggcgacgugggccaccaacauccagguggccaucaaccaggugcgccggcucaucggcaacgagaacuacuccgacuacaugaccagcaugaagcgcuucaagaacgaguccgagcccgagggggcccugugguga

SEQ ID NO: 8659 - RNA, 9879 nt, Artificial Sequence
  derived and/or modified CDS sequence (opt1) from DENV-1__GU131750__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccuguccaucgagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacgcugcuggccguguccggcguguacccgcucagcauccccgccacccuguucgucugguacuucuggcagaagaagaagcagcgcuccggggugcugugggacacccccagcccgcccgaggugggccgggccguccucgacgacggcaucuaccgcaucaugcagcgggggcugcugggccgcucccaggugggggugggcgucuuccaggagaacguguuccacaccauguggcacgugacgcgcggggccguccugauguaccagggcaagcgccucgagcccagcugggcguccgugaagaaggaccugaucagcuacggcgggggcuggcggcugcagggguccuggaacaccggcgaggaggugcaggucaucgccguggagcccgggaagaaccccaagaacgugcagaccgcccccggcaccuucaagacgcccgagggcgaggucggggccaucgcccucgacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcugcccgagaucgaggacgaggucuuccggaagcgcaaccucaccaucauggaccugcaccccgggagcggcaagacccggcgcuaccugccggcgaucgugcgggaggccaucaagcgcaagcuccgcacccugauccuggcccccacgcggguggucgccuccgagauggccgaggcgcucaagggcaugcccauccgcuaccagaccaccgccgucaagagcgagcacaccgggaaggagaucguggaccugaugugccacgccacguucaccaugcggcugcucucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcugucccggaagacguucgacaccgaguaccagaagaccaagaacaacgacugggacuacguggucaccacggacaucagcgagaugggggccaacuuccgcgcggaccgggugaucgacccgcgccggugccucaagcccgugauccugaaggacggccccgagcgcgucauccuggccgggcccaugccggugaccgucgccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccggcugcgcggggaggcgcggaagacguucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgccgcggggcgccggagcgucuccggcgaccugauccuggagaucggcaagcucccgcagcaccugaugcagcgcgcccagaacgcccuggacaaccucgugaugcugcacaacagcgagcagggcgggcgggccuaccgccacgcgauggaggagcugcccgacaccaucgagacgcucaugcugcuggcccucaucgccgugcugaccgggggcgucacccuguucuuccucuccgggcggggccugggcaagaccagcaucgggcugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucggccuccucuucaugauccugacgguggccgccaacgagauggggcugcucgagaccaccaagaaggaccugggcaucgggcacguggcggucgagaaccaccaccacgccgccaugcuggacguggaccuccaccccgccuccgccuggacccuguacgcgguggccacgaccaucaucaccccgaugaugcgccacaccaucgagaacacgaccgccaacaucagccugaccgccaucgccaaccaggcggccauccucaugggccuggacaagggcuggcccaucuccaagauggacaucggggucccccugcucgcccugggcugcuacagccaggugaacccccugacccucacggccgcggugcugaugcuggucgcccacuacgccaucaucgggccgggccuccaggccaaggccacccgcgaggcgcagaagcggaccgccgccgggaucaugaagaaccccaccguggacggcaucguggccaucgaccuggaccccgucguguacgacgccaaguucgagaagcagcugggccagaucaugcuccugauccugugcacgucccagauccuccugaugcgcaccaccugggcgcugugcgagagcaucacccucgccacggggccccugaccacccugugggagggcuccccggggaaguucuggaacaccacgaucgccgugagcauggccaacaucuuccggggcuccuaccucgccggcgcggggcuggccuucagccugaugaagucccucggcgggggccgccgggggaccggcgcccagggcgagacccugggggagaaguggaagcgccagcugaaccagcucuccaagagcgaguucaacaccuacaagcgguccggcaucauggaggucgaccgcagcgaggccaaggaggggcugaagcggggcgagacgaccaagcacgcggugucccgcgggaccgccaagcugcggugguucguggagcgcaaccucgucaagcccgagggcaaggugaucgaccugggcugcgggcggggcggguggagcuacuacugcgccggccugaagaaggugaccgaggucaagggguacacgaagggcggccccgggcacgaggagcccaucccgauggccaccuacggcuggaaccuggugaagcuccacuccgggaaggacguguucuucaucccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucacgauggcgcaccggaagcccaccuacgagcgcgacguggaccucggcgccggcacccggcacgucgccguggagcccgagguggccaaccuggacaucaucgggcagcgcaucgagaacaucaagcacgagcacaagagcaccuggcacuacgacgaggacaaccccuacaagacgugggccuaccacggcuccuacgaggucaagccgagcggguccgcgagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgccaaguggcuguggggcuuccugucccgcaacaagaagccccggaucugcacccgcgaggaguucacccggaaggugcgcagcaacgcggccaucggggccguguucgucgacgagaaccaguggaacuccgccaaggaggcgguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcccgcaucacggacaccauggagccggagcacgcccugcucgcgaaguccaucuucaagcugaccuaccagaacaaggugguccgcgugcagcggcccgccaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagacccccaaccuggccgagcgcgugcucgacuggcuggagaaguacggggucgagcggcugaagcgcauggccaucuccggcgacgacugcguggugaagccgaucgacgaccgguucgcgacggcccucaccgcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgccggguggagccugcgggagaccgcgugccugggcaaguccuacgcccagauguggcagcucauguacuuccaccgccgggaccugcgccuggccgccaacgcgaucugcagcgccguccccguggacuggauccccaccucccggacgaccuggagcauccacgcccaccaccaguggaugaccaccgaggacaugcucuccguguggaaccgcgucuggaucgaggagaaccccuggauggaggacaagacgcacaucagcuccuggggcgacgugccguaccugggcaagcgcgaggaccaguggugcggcagccugaucgggcucaccgcccgggccaccugggcgaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8660 - RNA, 9879 nt, Artificial Sequence
  derived and/or modified CDS sequence (opt1) from DENV-1__GU131751__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggggaguucugcgaggacacgaugaccuacaagugcccccgcaucaccgaggccgagcccgacgacguggacugcuggugcaacgccaccgacaccugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaucgcgaccaucacgccccaggcccccagcaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacgagcggggccuccaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucaccuccgucgggaagcuggugcaccagaucuucggcacggccuacggggugcuguucagcggcgucuccuggaccaugaagaucgggaucggcgugcuccugaccuggcugggccucaacagccgcuccaccagccuguccaugacgugcaucgccguggggcuggucacccucuaccugggcgugauggugcaggccgacagcgggugcgucaucaacuggaagggccgggagcugaagugcgggagcggcaucuucgugaccaacgaggugcacaccuggacggagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaaggugauccggccccagcccauggagcacaaguacuccuggaaguccuggggcaaggccaagaucaucggcgccgacguccagaacaccaccuucaucaucgacgggcccaacacgccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccauccgggacuccaaggccguccacgccgacaugggcuacuggaucgagagcgagaagaacgagacguggaagcucgcgcgcgccuccuucaucgaggugaagaccugcaucuggcccaagagccacacccugugguccaacggcgugcuggagagcgagaugaucauccccaagaucuacgggggcccgaucucccagcacaacuaccggcccggguacuucacccagacggccggccccuggcaccucgggaagcuggagcuggacuucgaccucugcgagggcaccaccgucgugguggacgagcacugcggcaaccgcgggccgagccugcggaccacgaccgucaccggcaagaucauccacgaguggugcugccgcuccugcacccugccgccccugcgguucaagggggaggacggcugcugguacgggauggagauccgccccgugaaggagaaggaggagaaccuggucaagagcauggucagcgccggcuccggcgagguggacagcuucucccuggggcuccugugcaucagcaucaugaucgaggaggugaugcgguccaaguggagccgcaagaugcugaugacgggcacccucgccgucuucuuccugcugaucauggggcagcucaccuggaacgaccugauccggcugugcaucauggugggcgcgaacgccuccgaccgcauggggaugggcaccacguaccucgcccugauggccaccuucaagaugcgcccgauguucgccgugggccuccuguuccggcgccugaccagccgggagguccugcuccugaccaucgggcugucccucguggcgagcgucgagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgauggugcuguccaucgugagccuguucccccucugccuguccaccaccagccagaagacgaccuggcugcccguccuccugggcucccuggggugcaagccgcucaccauguuccugaucgccgagaacaagaucuggggccgcaagagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggaccaugaagaucaaggacgaggagcgggacgacacgcugaccauccugcucaaggccacccugcuggccgugagcggcgucuacccgcucuccauccccgccacccuguucgugugguacuucuggcagaagaagaagcagcgcagcggggugcugugggacauccccagcccgcccgaggucgagcgggccgugcucgacgacggcaucuaccgcaucaugcagcggggccugcuggggcgcagccaggugggcgucgggguguuccaggagaacguguuccacaccauguggcacgucacgcggggcgcggugcugauguaccaggggaagcgccucgagcccuccugggccagcgugaagaaggaccugaucuccuacggcggcggguggcggcugcagggcagcuggaacaccggggaggagguccaggugaucgccguggagcccggcaagaaccccaagaacguccagaccgcccccgggaccuucaagacguccgagggcgaggugggcgccaucgcgcucgacuucaagcccgggaccagcggcagccccaucgugaaccgcgaggggaagaucgucggccuguacggcaacgggguggugaccaccuccggcacguacgucagcgccaucgcccaggccaaggcgucccaggaggggccccugccggagaucgaggacgagguguucaagaagcggaaccucaccaucauggaccugcaccccggcagcgggaagacccgccgguaccugcccgccaucgugcgcgaggccaucaagcggaagcuccgcacccugauccuggccccgacgcgggucguggccuccgagauggcggaggcccucaagggcaugcccauccgcuaccagaccaccgccgucaagagcgagcacaccggcaaggagaucgucgaccugaugugccacgccacguucaccaugcgccugcucucccccgugcgggugcccaacuacaacaugaucaucauggacgaggcccacuucaccgacccgagcuccaucgcggcccgcggguacaucagcacccgggucggcaugggggaggccgccgccaucuucaugacggcgacgccgcccggcuccguggaggccuucccccagagcaacgccgugauccaggacgaggagcgcgacaucccggagcgguccuggaacagcggguacgaguggaucaccgacuuccccggcaagaccgucugguucgugcccuccaucaagagcggcaacgacaucgccaacugccugcgcaagaacgggaagcgggugauccagcugucccgcaagacguucgacaccgaguaccagaagaccaagaacaacgacugggacuacgucgugaccacggacaucagcgagaugggcgcgaacuuccgggccgaccgcgugaucgacccccggcgcugccucaagccggucauccugaaggacgggcccgagcgggugauccuggccggccccaugcccgucaccguggccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccggcugcgcggcgaggcccgcaagacguucguggagcugaugcggcgcggggaccucccggucuggcugagcuacaagguggccuccgagggcuuccaguacagcgaccggcgcuggugcuucgacggcgagcggaacaaccaggugcuggaggagaacauggacgucgagaucuggaccaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacacgaucgagacccucaugcugcuggcccucaucgccguccugaccggcggggugacccuguucuuccucuccggccgcgggcugggcaagacgagcaucggccugcucugcgugauggccuccagcguccugcuguggauggcguccguggagccccacuggaucgccgccagcaucauccucgaguucuuccugauggugcugcucauccccgagcccgaccggcagcgcaccccgcaggacaaccagcuggccuacgucgugaucgggcuccucuucaugauccugaccguggccgcgaacgagaugggccugcucgagaccaccaagaaggaccuggggaucggccacgucgccguggagaaccaccaccacgccgccaugcuggacguggaccuccaccccgccuccgcguggacgcuguacgccgucgccaccaccaucaucacccccaugaugcggcacacgaucgagaacaccaccgccaacaucagccugaccgccaucgcgaaccaggccgccauccucauggggcuggacaagggcuggccgaucuccaagauggacaucggcgugccccugcucgcccuggggugcuacagccaggugaacccccugacgcucaccgcgaccguccugaugcugguggcccacuacgccaucaucggccccgggcuccaggccaaggccacccgcgaggcgcagaagcggacggccgccggcaucaugaagaacccgaccguggacgggaucgucgccaucgaccuggaccccgugguguacgacgccaaguucgagaagcagcugggccagaucaugcuccugauccugugcaccucccagauccuccugaugcgcaccacgugggcgcugugcgagagcaucacccucgccaccggcccccugaccacgcugugggaggggucccccggcaaguucuggaacaccaccaucgccgucagcauggccaacaucuuccgcgggagcuaccucgccggcgcgggccuggccuucucccugaugaagucccucgggggcgggcggcgcggcaccggggcccagggcgagacgcugggcgagaaguggaagcggcagcugaaccagcucuccaagagcgaguucaacaccuacaagcgcuccgggaucauggagguggaccggagcgaggccaaggagggccugaagcgcggggagaccaccaagcacgcggugucccggggcacggccaagcugcgcugguucgucgagcggaaccucgugaagccggaggggaaggugaucgaccugggcugcggccgcgggggcuggagcuacuacugcgccgggcugaagaaggucaccgaggugaagggcuacaccaagggcgggcccggccacgaggagcccauccccauggccaccuacggguggaaccuggugaagcuccacuccggcaaggacgucuucuucaucccgcccgagaagugcgacacgcugcugugcgacaucggggagagcucccccaaccccaccaucgaggagggccggacccuccgcgugcugaagaugguggagccguggcugcgggggaaccaguucugcaucaagauccucaaccccuacaugcccagcgucguggagacccuggagcagaugcagcgcaagcacggcggcaugcuggugcggaacccccucucccgcaacagcacgcacgagauguacugggucuccugcgggaccggcaacaucgugagcgccgugaacaugaccucccggaugcugcugaaccgcuucaccauggcgcaccggaagccgaccuacgagcgcgacgucgaccucggggccggcacgcgccacguggccguggagcccgaggucgccaaccuggacaucaucggccagcggaucgagaacaucaagcacgagcacaagagcaccuggcacuacgacgaggacaaccccuacaagaccugggccuaccacggguccuacgaggugaagcccagcggcagcgcguccagcauggucaacgggguggugaagcugcucaccaagccgugggacgucauccccauggugacgcagaucgccaugaccgacaccacccccuucggccagcagcgcguguucaaggagaaggucgacacgcggacccccaaggccaagcgcgggaccgcccagaucauggaggugaccgccaaguggcuguggggcuuccugucccggaacaagaagccgcgcaucugcacgcgggaggaguucacccgcaaggugcggagcaacgcggccaucggcgccgucuucguggacgagaaccaguggaacuccgccaaggaggcgguggaggacgagcgcuucugggaccucguccaccgggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacgcgcaucaccgaggacgaccugcagaacgaggccaagaucaccgacaucauggagcccgagcacgcccugcucgcgaaguccaucuucaagcugaccuaccagaacaaggucgugcgggugcagcgcccggccaagaacgggacggucauggacgugaucagccggcgcgaccagcgcggcuccggccaggugggcaccuacggccugaacaccuucaccaacauggaggcccagcucauccggcagauggagagcgaggggaucuucucccccagcgagcuggagacgcccaaccuggccggccgcguccucgacuggcuggagaaguacgggguggagcggcugaagcgcauggccaucuccggcgacgacugcguggucaagcccaucgacgaccgguucgcgaccgcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucgucgugcccugccgcaaccaggacgagcucguggggcgggcccgcgucucccagggcgccggguggagccugcgggagaccgcgugccugggcaaguccuacgcccagauguggcagcucauguacuuccaccgccgggaccugcgccuggccgccaacgcgaucugcagcgccgugccgguggacuggguccccacgucccggaccaccuggagcauccacgcccaccaccaguggaugaccacggaggacaugcucuccguguggaaccgcguguggaucgaggagaaccccuggauggaggacaagacccacaucagcuccuggggcgacguccccuaccugggcaagcgggaggaccaguggugcggcagccugaucgggcucaccgcccgcgccaccugggcgacgaacauccagguggccaucaaccaggugcggcgccugaucggcaacgagaacuaccuggacuacaugaccuccaugaagcgcuucaagaacgagagcgacccggagggggcccucugguga

SEQ ID NO: 8661 - RNA, 9879 nt, Artificial Sequence
  derived and/or modified CDS sequence (opt1) from DENV-1__GU131753__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccggaccgagaccuggauguccagcgagggcgccuggaagcagauccagcgggucgagacgugggcccuccgccaccccggguucaccgugaccgcccuguuccuggcgcacgccaucggcaccuccaucacgcagaaggggaucaucuucauccuccugaugcuggugacccccagcauggccaugcggugcgucggcaucggcucccgcgacuucguggaggggcucagcggcgccaccuggguggacgucgugcuggagcacggguccugcgugaccacgauggccaaggacaagcccacccuggacaucgagcuccugaagaccgaggucaccaaccccgcggugcugcggaagcucugcaucgaggccaagaucagcaacacgaccaccgacucccgcugccccacccagggcgaggccacgcugauggaggagcaggacgccaacuucgugugccggcgcaccuucgucgaccggggcugggggaacggcugcgggcuguucggcaaggggagccucaucacgugcgccaaguucaagugcgugaccaagcuggagggcaagaucgugcaguacgagaaccugaaguacuccgucaucgugacggugcacaccggcgaccagcaccaggucgggaacgagagcaccgagcacggcaccaccgcgacgaucacgccccaggcccccaccuccgagauccagcucaccgacuacggggcccugacgcuggacugcagcccccgcaccggccucgacuucaacgagauggugcugcugaccaugaaggagaaguccuggcucguccacaagcagugguuccuggaccugccgcuccccuggaccagcggggccagcacgucccaggagaccuggaaccggcaggaccugcuggugaccuucaagaccgcccacgcgaagaagcaggagguggucgugcucggcagccaggagggcgccaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgcggagacccagcacggcaccgugcuggugcagaucaaguacgagggcaccgacgcccccugcaagauccccuucagcacgcaggacgagaagggggucacccagaacggccggcugaucaccgccaacccgaucaucaccgacaaggagaagcccgugaacaucgaggccgagccgcccuucggggaguccuacaucgugaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcgucuucaccagcaucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucacggugguggucggggacguggugggcauccucgcgcaggggaagaagaugauccggccccagcccauggagcacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagaugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgucgugguggacgagcacugcggcaaccgggggccgucccugcgcaccaccacggucaccggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccuggggcuccugugcaucuccaucaugaucgaggaggugaugcgcagccgguggucccgcaagaugcugaugaccggcacgcucgccgucuuccugcugcucaucauggggcagcugaccuggaacgaccugauccggcucugcaucauggugggcgccaacgcgagcgaccgcauggggaugggcaccaccuaccuggcccugauggccacguucaagaugcgcccgauguucgccgugggccuccuguuccggcgccugaccucccgggagguccuccugcugaccaucgggcucagccugguggccuccguggagcugcccaacagccucgaggagcugggcgacgggcuggcgaugggcaucaugauccucaagcugcugaccgacuuccagucccaccagcucugggccacgcugcugagccucaccuucaucaagaccacccugucccugcacuacgccuggaagacgauggccaugguccucagcaucgugucccugaucccccugugccucagcaccaccucccagaagaccacguggcugcccguccugcucggcagccuggggugcaagccgcugaccauguuccucaucgcggagaacaagaucuggggccgcaaguccuggccccugaacgaggggaucauggccgugggcguggucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaugaagcgcaagcugcggacccucauccuggcccccacgcgcgugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucacggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggcgguggagaaccaccaccacgccaccaugcuggacgucgaccugcaccccgccuccgccuggacccucuacgccguggcgaccacgaucaucaccccgaugaugcgccacaccaucgagaacaccacggccaacaucagccugaccgccaucgccaaccaggccgcgauccugauggggcucgacaagggcuggcccaucuccaagauggacaucggcgugccccugcuggcccucgggugcuacagccaggucaacccccugacccugaccgccgccgugcucaugcugguggcgcacuacgccaucaucggcccggggcugcaggccaaggccacgcgggaggcccagaagcgcaccgcggccggcaucaugaagaaccccaccgucgacgggaucguggccaucgaccucgaccccguggucuacgacgccaaguucgagaagcagcugggccagaucaugcugcucauccugugcaccucccagauccugcucaugcgcacgaccugggcccugugcgagagcaucacccuggcgaccggcccccucacgacccugugggagggguccccgggcaaguucuggaacaccaccaucgccgugagcauggccaacaucuuccggggguccuaccuggccggcgccggccucgcguucagccugaugaagucccucgggggcgggcgccgggggacgggggcccagggcgagacccucggcgagaaguggaagcgccagcugaaccagcuguccaagagcgaguucaacaucuacaagcgguccgggaucauggagguggaccgcagcgaggccaaggagggccucaagcgcggggagaccaccaagcacgccgucucccgcggcacggcgaagcugcggugguucguggagcgcaaccuggugaagcccgaggggaaggucaucgaccugggcugcggccgcggcggguggagcuacuacugcgccgggcucaagaaggugaccgaggugaagggguacaccaagggcgggcccggccacgaggagcccaucccgauggccaccuacggguggaaccuggucaagcugcacuccggcaaggacguguucuucacgccgcccgagaagugcgacacccuccugugcgacaucggggagagcucccccaacccgaccaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacgcacgagauguacuggguguccugcgggaccggcaacaucgugagcgccgucaacaugaccucccgcaugcuccugaaccgguucaccauggcccaccgcaagcccacguacgagaaggacguggaccugggggcgggcacccgccacguggccgucgagcccgagguggccaaccucgacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggucaagcugcugacgaagcccugggacgugauccccauggugacccagaucgcgaugaccgacaccacgcccuucggccagcagcgcgucuucaaggagaagguggacacccggaccccgaaggccaagcgcgggaccgugcagaucauggaggucacggcccgguggcucuggggcuuccugucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccuggugaagaaggagcgcgagcuccacaagcaggggaagugcgcgaccugcgucuacaacaugaugggcaagcgggagaagaagcugggggaguucggcaaggcgaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacacggcgggcugggacacccgcaucaccgaggacgaccuccagaacgaggccaagaucaccgacaucauggagccggagcacgcccugcuggccacguccaucuucaagcucaccuaccagaacaaggugguccgggugcagcgccccgccaagaacgggaccgugauggacgucaucagccggcgcgaccagcgcggcuccggccaggugggcaccuacggccugaacacguucaccaacauggaggcgcagcugauccggcagauggagagcgaggggaucuuccuccccuccgagcuggagacccccaaccuggccgagcgcguguucgacuggcucgagaaguacggcgucgagcggcugaagcgcauggccaucagcggggacgacugcguggugaagccgaucgacgaccgguucgccaccgcccugacggcgcucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcccgcgugucccagggggccggcuggagccuccgggagaccgccugccugggcaagagcuacgcccagauguggcagcugauguacuuccaccgccgggaccuccgccuggcggccaacgccaucugcuccgccguccccguggacugggugcccaccagccggaccacgugguccauccacgcgcaccaccaguggaugaccaccgaggacaugcugagcgucuggaaccgcguguggaucgaggagaaccccuggauggaggacaagacccacguguccagcuggggcgacgucccguaccucgggaagcgggaggaccaguggugcggcucccugaucggccugaccgcccgcgccacgugggccagcaacauccagguggccaucaaccaggugcggcgccucaucgggaacgagaacuaccuggacuacaugaccuccaugaagcgcuucaagaacgagggcgaccccgagggggcgcugugguga

SEQ ID NO: 8662 - RNA, 9879 nt, Artificial Sequence
  derived and/or modified CDS sequence (opt1) from DENV-1__GU131754__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggacaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucgugaacuggaagggccgggagcugaagugcgggagcggcaucuucgugaccaacgagguccacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccuguuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgugagccuguucccccucugcauguccaccacgagccagaagaccaccuggcugcccguccugcucggcucccuggggugcaagccgcugaccauguuccucaucgccgagaacaagaucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgcuguccauccccgccacccucuucgugugguacuucuggcagaagaagaagcagcgcagcggggugcugugggacacgcccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgcggugcugauguaccaggggaagcgccuggagcccuccugggccagcgugaagaaggaccucaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgcgaggggaagaucgucggccucuacggcaacgggguggugacgaccuccggcaccuacgucagcgccaucgcccaggccaaggcgucccaggaggggccccugccggagaucgaggacgagguguuccggaagcgcaaccugaccaucauggaccuccaccccggcagcgggaagacgcggcgcuaccugcccgccaucgugcgggaggccaucaagcgcaagcugcggacccucauccuggccccgacccgcgucguggccuccgagauggcggaggcccugaagggcaugcccauccgcuaccagaccacggccgucaagagcgagcacaccggcaaggagaucgucgaccucaugugccacgccaccuucaccaugcggcugcugucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccuccggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccugaagccggucauccucaaggacgggcccgagcgcgugauccuggccggccccaugcccgucaccguggccuccgccgcgcagcggcgcgggcggaucggccgcaaccacaacaaggagggcgaccaguacguguacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucgucgagcugaugcgccgcggggaccugccgguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccccagcaccucacccagcgcgcccagaacgcccuggacaaccuggucaugcuccacaacagcgagcagggcgggcgggcguaccgccacgccauggaggagcugccggacaccaucgagacccugaugcuccuggcccugaucgccgugcucacgggcggggugacccuguucuuccuguccggccgggggcucggcaagaccagcaucggccugcugugcgucauggccuccagcgcgcuccuguggauggccuccguggagccccacuggaucgccgccagcaucauccuggaguucuuccucauggugcugcugauccccgagcccgaccgccagcggaccccgcaggacaaccagcucgccuacgucgugaucgggcugcuguucaugauccucaccguggcggccaacgagaugggccugcuggagacgaccaagaaggaccucgggaucggccacgucgccguggagaaccaccaccacgccgccaugcuggacguggaccugcaccccgcguccgccuggacccucuacgccgucgccaccacgaucaucacccccaugaugcgccacaccaucgagaacaccacggccaacaucagccugaccgcgaucgccaaccaggccgccauccugauggggcucgacaagggcuggccgaucuccaagauggacaucggcgugccccugcuggcgcucgggugcuacagccaggugaacccccugacccugaccgccgccguccucaugcugguggcccacuacgccaucaucggccccgggcugcaggcgaaggccacgcgggaggcccagaagcgcaccgccgccggcaucaugaagaacccgaccguggacgggaucgucgcgaucgaccucgaccccgugguguacgacgccaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgucagcauggcgaacaucuuccgggggagcuaccuggccggcgccggccucgccuucucccugaugaagucccucgggggcgggcgccgggggacgggggcgcagggcgagacccucggcgagaaguggaagcgccagcugaaccagcuguccaagagcgaguucaacaccuacaagcgguccgggaucauggagguggaccgcagcgaggccaaggagggccucaagcgcggggagaccacgaagcacgccgugucccgcggcaccgccaagcugcggugguucgucgagcgcaaccuggugaagccggaggggaaggugaucgaccucggcugcggccgcggcggguggagcuacuacugcgccgggcugaagaaggucaccgaggugaagggguacaccaagggcgggcccggccacgaggagcccauccccauggcgacguacggguggaaccuggugaagcugcacuccggcaaggacgucuucuucaucccgcccgagaagugcgacacccuccugugcgacaucggggagagcucccccaaccccaccaucgaggagggccgcacccugcgggugcucaagaugguggagccguggcugcgcgggaaccaguucugcaucaagauccugaaccccuacaugcccagcgucguggagacgcucgagcagaugcagcggaagcacggcggcaugcuggugcgcaacccccugucccggaacagcacccacgagauguacugggucuccugcgggaccggcaacaucgugagcgccgugaacaugaccucccgcaugcuccugaaccgguucaccauggcccaccgcaagccgacguacgagcgcgacgucgaccugggggccggcacccggcacguggccguggagcccgaggucgcgaaccucgacaucaucggccagcgcaucgagaacaucaagcacgagcacaagagcaccuggcacuacgacgaggacaaccccuacaagaccugggccuaccacggguccuacgaggugaagcccagcggcagcgccuccagcauggucaacgggguggugaagcugcugacgaagccgugggacgucauccccauggugacccagaucgccaugaccgacaccacgcccuucggccagcagcggguguucaaggagaaggucgacacccgcacccccaaggccaagcgggggaccgcgcagaucauggaggugacggccaaguggcucuggggcuuccugucccgcaacaagaagccgcggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggcgaagaucaccgacaucauggagcccgagcacgcccugcuggccaaguccaucuucaagcucacguaccagaacaaggucgugcgcgugcagcggccggccaagaacgggaccgucauggacgugaucagccgccgcgaccagcggggcuccggccaggugggcaccuacggccugaacaccuucacgaacauggaggcccagcugauccgccagauggagagcgaggggaucuucucccccagcgagcucgagacccccaaccuggcgggccggguccuggacuggcucgagaagcacgggguggagcgccugaagcggauggccaucuccggcgacgacugcguggucaagcccaucgacgaccgcuucgccaccgcccugaccgcccucaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcugguggggcgcgcgcgggucucccagggcgccggguggagccuccgcgagacggccugccugggcaaguccuacgcccagauguggcagcugauguacuuccaccggcgcgaccuccggcuggcggccaacgccaucugcagcgccgugccgguggacuggguccccaccucccgcaccaccuggagcauccacgcccaccaccaguggaugacgaccgaggacaugcuguccguguggaaccggguguggaucgaggagaaccccuggauggaggacaagacccacaucagcuccuggggcgacguccccuaccucggcaagcgcgaggaccaguggugcggcagccugaucgggcugaccgcgcgggccacgugggccaccaacauccagguggccaucaaccaggugcgccgccucaucggcaacgagaacuaccuggacuacaugaccuccaugaagcgguucaagaacgagagcgacccggagggggcccugugguga

SEQ ID NO: 8663 - RNA, 9879 nt, Artificial Sequence
  derived and/or modified CDS sequence (opt1) from DENV-1__GU131755__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagauccgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacugcgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggacaagcagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucaucgacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcuggagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8664 - RNA, 9879 nt, Artificial Sequence
  derived and/or modified CDS sequence (opt1) from DENV-1__GU131756__SS-prME
agcgugaccaugcugcugaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccgcguucuuccugcucaucauggggcagcugaccuggaacgaccugauccggcucugcaucauggugggcgccaacgccuccgaccgcauggggaugggcacgaccuaccuggcccugauggccaccuucaagaugcgcccgauguucgcggucgggcuccuguuccggcgccugaccagccgggaggugcuccugcugacgaucgggcucucccugguggccagcgucgagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgcguggaagaccauggccauggugcuguccaucgucagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgugggcaucgucagcauccugcuguccagccuccugaagaacgacgugccccuggccgggccccucaucgcgggcggcaugcugaucgccugcuacgugaucuccgggagcuccgccgaccugagccucgagaaggccgccgucguguccugggaggaggaggcggagcacagcggcgccucccacaacauccugguggagguccaggacgacgggacgaugaagaucaaggacgaggagcgcgacgacacccugaccauccuccugaaggccacccugcucgccgugagcggcguguacccgcuguccauccccgccacccuguucgucugguacuucuggcagaagaagaagcagcggagcggggugcucugggacacgcccagcccgcccgagguggagcgcgcgguccuggacgacggcaucuaccggaucaugcagcgcggccugcuggggcggagccaggugggcgugggggucuuccaggagaacguguuccacaccauguggcacgugacccgcggcgccguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccuccgagggcgaggucggcgcgaucgcccuggacuucaagcccgggaccagcggcagccccaucgugaaccgggaggggaagaucgugggccuguacggcaacggggucgugacgaccuccggcaccuacgugagcgccaucgcccaggcgaaggccucccaggaggggccccucccggagaucgaggacgaggucuuccgcaagcggaaccugaccaucauggaccugcaccccggcagcgggaagacgcgccgguaccuccccgccaucgugcgcgaggccaucaagcggaagcugcgcacccugauccucgccccgacccgcguggucgcguccgagauggccgaggcccugaagggcaugcccauccgguaccagaccacggccgucaagagcgagcacaccggcaaggagaucguggaccugaugugccacgccaccuucaccaugcgccuccugucccccguccgggugcccaacuacaacaugaucaucauggacgaggcgcacuucacggacccgagcuccaucgccgcccgcggguacaucagcacccgggugggcaugggggaggccgccgcgaucuucaugaccgccacgccgcccggcuccgucgaggccuucccccagagcaacgccgugauccaggacgaggagcgcgacaucccggagcgguccuggaacagcggguacgaguggaucacggacuuccccggcaagaccgugugguucguccccuccaucaagagcggcaacgacaucgcgaacugccugcgcaagaacgggaagcgggugauccagcucucccgcaagaccuucgacaccgaguaccagaagacgaagaacaacgacugggacuacguggucaccaccgacaucagcgagaugggcgccaacuuccgggccgaccgcgugaucgacccccggcgcugccugaagccggugauccugaaggacgggcccgagcgggucauccucgccggccccaugcccgugaccgucgccuccgcggcccagcgccgggggcgcaucggccggaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgcggccaucgacggggaguaccgccugcggggcgaggcccgcaagaccuucguggagcucaugcggcgcggggaccugccgguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccccucgcgcugcgcgaguucaaggaguucgccgccggccggcgcagcgucuccggggaccugauccucgagaucggcaagcugccccagcaccugacccagcgggcccagaacgcgcucgacaaccuggugaugcugcacaacagcgagcagggcgggcgcgccuaccggcacgccauggaggagcucccggacaccaucgagacccugaugcugcucgcccugaucgccgugcugacgggcggggucacccucuucuuccuguccggccgcgggcugggcaagaccagcaucggccuccugugcgugauggcguccagcgugcugcucuggauggccuccgucgagccccacuggaucgccgccagcaucauccuggaguucuuccugauggugcuccugauccccgagcccgaccggcagcgcaccccgcaggacaaccagcuggccuacguggucaucgggcuccuguucaugauccugaccguggcggccaacgagaugggccuccuggagacgaccaagaaggaccuggggaucggccacguggccgucgagaaccaccaccacgccgccaugcucgacguggaccugcaccccgcguccgccuggacccuguacgccguggccaccacgaucaucacccccaugaugcggcacaccaucgagaacaccacggccaacaucagccucaccgcgaucgccaaccaggccgccauccugauggggcuggacaagggcuggccgaucuccaagauggacaucggcgucccccuccuggcgcuggggugcuacagccaggugaacccccucacccugaccgccgccgugcugaugcucgucgcccacuacgccaucaucggccccgggcugcaggcgaaggccacgcgcgaggcccagaagcgcaccgccgccggcaucaugaagaacccgaccguggacgggaucguggcgaucgaccuggaccccgucguguacgacgccaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgugagcauggcgaacaucuuccgcgggagcuaccuggccggcgccggccuggccuucucccucaugaagucccucgggggcgggcggcgcgggacgggggcgcagggcgagacccugggcgagaaguggaagcggcagcucaaccagcuguccaagagcgaguucaacaccuacaagcgcuccgggaucauggaggucgaccggagcgaggccaaggagggccugaagcgcggggagaccacgaagcacgccgugucccggggcaccgccaagcuccgcugguucguggagcggaaccuggucaagccggaggggaaggugaucgaccugggcugcggccgcgggggcuggagcuacuacugcgccgggcugaagaaggugaccgaggucaagggcuacaccaagggcgggcccggccacgaggagcccauccccauggcgacguacggguggaaccucgugaagcugcacuccggcaaggacguguucuucaucccgcccgagaagugcgacacccugcucugcgacaucggggagagcucccccaaccccaccaucgaggagggccggacccugcgcguccugaagaugguggagccguggcuccgggggaaccaguucugcaucaagauccugaaccccuacaugcccagcguggucgagacgcuggagcagaugcagcgcaagcacggcggcaugcucgugcggaacccccugucccgcaacagcacccacgagauguacuggguguccugcgggaccggcaacaucgucagcgccgugaacaugaccucccggaugcugcucaaccgcuucaccauggcccaccgcaagccgacguacgagcgggacguggaccugggggccggcacccgccacgucgccguggagcccgagguggcgaaccuggacaucaucggccagcggaucgagaacaucaagcacgagcacaagagcaccuggcacuacgacgaggacaaccccuacaagaccugggccuaccacggguccuacgaggucaagcccagcggcagcgccuccagcauggugaacggggucgugaagcuccugacgaagccgugggacgugauccccauggucacccagaucgccaugaccgacaccacgcccuucggccagcagcgcguguucaaggagaagguggacacccggacccccaaggccaagcgcgggaccgcgcagaucauggaggucacggccaaguggcuguggggcuuccucucccggaacaagaagccgcgcaucugcacccgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcgaagaucaccgacaucauggagcccgagcacgcccuccuggccaaguccaucuucaagcugacguaccagaacaaggugguccgggugcagcgcccggccaagaacgggaccgugauggacgucaucagccgccgggaccagcgcggcuccggccaggugggcaccuacggccucaacaccuucacgaacauggaggcccagcugauccggcagauggagagcgaggggaucuucucccccagcgagcuggagacccccaaccucgcgggccgcgugcuggacuggcuggagaagcacggggucgagcggcucaagcgcauggccaucuccggcgacgacugcguggugaagcccaucgacgaccgguucgccaccgcccugaccgcccugaacgacauggggaagguccgcaaggacaucccgcagugggagcccagcaagggcuggaacgacuggcagcagguccccuucugcagccaccacuuccaccagcucaucaugaaggacggccgggagaucgugguccccugccgcaaccaggacgagcugguggggcgggcgcgcgugucccagggcgccggguggagccugcgggagacggccugccucggcaaguccuacgcccagauguggcagcugauguacuuccaccgccgggaccugcgccucgcggccaacgccaucugcagcgccgucccgguggacugggugcccaccucccggaccaccuggagcauccacgcccaccaccaguggaugacgaccgaggacaugcuguccgucuggaaccgcguguggaucgaggagaaccccuggauggaggacaagacccacaucagcuccuggggcgacgugcccuaccugggcaagcgggaggaccaguggugcggcagccucaucgggcugaccgcgcgcgccacgugggccaccaacauccaggucgccaucaaccaggugcgccggcugcucggcaacgagaacuaccuggacuacaugaccuccaugaagcgcuucaagaacgagagcgacccggagggggcccugugguga

SEQ ID NO: 8665 - RNA, 9879 nt, Artificial Sequence
  derived and/or modified CDS sequence (opt1) from DENV-1__GU131758__SS-prME
agcgugacgaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgugcccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgcuccaccagccuguccaugaccugcaucgccgucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggccgacuccccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucacguggaacgaccugauccggcugugcaucauggugggcgccaacgcguccgaccgcauggggaugggcaccaccuaccucgcccugauggccaccuucaagaugcgcccgauguucgccgugggccuccuguuccggcgccugacgagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacccuccuguccuucacguucaucaagaccaccuucagccugcacuacgccuggaagaccauggccauggugcucuccaucgugagccuguucccccugugccucuccacgaccagccagaagaccaccuggcugcccguccugcucggcucccuggggugcaagccgcugacgauguuccucaucgcggagaacaagguguggggccgcaagagcuggccccugaacgaggggaucauggccgugggcaucgucagcauccugcucuccagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacccuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacaccauguggcacgugacccggggcgccgugcugauguaccaggggaagcgccuggagcccuccugggcgagcgucaagaaggaccucaucuccuacggcggcggguggcggcugcagggcagcuggaacacgggggaggagguccaggugaucgccgucgagcccggcaagaaccccaagaacgugcagaccgcccccgggaccuucaagaccuccgagggcgaggugggcgccaucgcccuggacuucaagcccgggacgagcggcagccccaucgucaaccgcgaggggaagaucgugggccucuacggcaacgggguggucaccaccuccggcaccuacgugagcgcgaucgcccaggccaaggccucccaggaggggccccugccggagaucgaggacgagguguuccggaagcgcaaccugacgaucauggaccuccaccccggcagcgggaagacccggcgcuaccugcccgcgaucguccgggaggccaucaagcgcaagcugcggacccucauccuggccccgacccgcgugguggccuccgagauggccgaggcgcugaagggcaugcccauccgcuaccagacgaccgccgucaagagcgagcacaccggcaaggagaucguggaccucaugugccacgccaccuucacgaugcggcugcugucccccgugcgcguccccaacuacaacaugaucaucauggacgaggcccacuucaccgacccgagcuccaucgccgcgcggggguacaucagcacccgcgugggcaugggggaggccgccgccaucuucaugaccgccacgccgcccggcuccguggaggcguucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgccaacuuccgcgcggaccgggucaucgacccccgccggugccugaagccggugauccucaaggacgggcccgagcgcgucauccuggccggccccaugcccgugacgguggccuccgccgcccagcggcgcgggcggaucggccgcaaccacaacaaggagggcgaccaguacaucuacauggggcagccgcugaacaacgacgaggaccacgcgcacuggaccgaggccaagaugcuccuggacaacaucaacacccccgagggcaucauccccgcccuguucgagcccgagcgggagaaguccgccgccaucgacggggaguaccgccuccgcggcgaggcgcggaagaccuucgucgagcugaugcgccgcggggaccugccgguguggcucagcuacaagguggccuccgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccccagcaccucacccagcgcgcccagaacgcccuggacaaccuggucaugcuccacaacagcgagcagggcgggcgggccuaccgccacgcgauggaggagcugccggacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagcccgaccgccagcggaccccgcaggacaaccagcucgccuacguggugaucgggcugcuguucaugauccucacggucgccgccaacgagaugggccugcuggagaccaccaagaaggaccucgggaucggccacgcggccguggagaaccaccaccacgccgccaugcuggacguggaccugcaccccgccuccgcguggacccucuacgccgucgccacgaccaucaucacccccaugaugcgccacaccaucgagaacacgaccgccaacaucagccugaccgccaucgcgaaccaggccgccauccugauggggcucgacaagggcuggccgaucuccaagauggacaucggcgugccccugcuggcccucgggugcuacagccaggugaacccccugacccugacggcggccguccucaugcugguggcccacuacgccaucaucggccccgggcugcaggccaaggcgacccgggaggcccagaagcgcaccgccgccggcaucaugaagaacccgaccguggacgggaucgucgccaucgaccucgaccccgugguguacgacgcgaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgccgucagcauggccaacaucuuccgggggagcuaccuggcgggcgccggccucgccuucucccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgugucccgcggcaccgccaagcugcggugguucgucgagcgcaaccuggugaagccggaggggaaggugaucgaccucggcugcggccgcggcggguggagcuacuacugcgccgggcugaagaaggucaccgaggugaagggguacacgaagggcgggcccggccacgaggagcccauccccauggccaccuacggguggaaccuggugaagcugcacuccggcaaggacgucuucuucaucccgcccgagaagugcgacacccuccugugcgacaucggggagagcucccccaaccccaccaucgaggagggccgcacgcugcgggugcucaagaugguggagccguggcugcgcgggaaccaguucugcaucaagauccugaaccccuacaugcccagcgucguggagacccucgagcagaugcagcggaagcacggcggcaugcuggugcgcaacccccugucccggaacagcacccacgagauguacugggucuccugcgggaccggcaacaucgugagcgcggugaacaugaccucccgcaugcuccugaaccgguucacgauggcccaccgcaagccgaccuacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagacgugggcguaccacggguccuacgaggugaagcccagcggcagcgccuccagcauggucaacgggguggugaagcugcugaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcgaaguggcucuggggcuuccugucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgccacgugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagcccgagcacgcgcugcuggccaaguccaucuucaagcucaccuaccagaacaaggucgugcgcgugcagcggccggccaagaacgggaccgucauggacgugaucagccgccgcgaccagcggggcuccggccaggugggcaccuacggccugaacacguucaccaacauggaggcccagcugauccgccagauggagagcgaggggaucuucucccccagcgagcucgagacccccaaccuggccggccggguccuggacuggcucgagaagcacgggguggagcgccugaagcggauggcgaucuccggcgacgacugcguggucaagcccaucgacgaccgcuucgccaccgcccugacggcccucaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcugguggggcgcgcccgggucucccagggcgcgggguggagccuccgcgagaccgccugccugggcaaguccuacgcccagauguggcagcugauguacuuccaccggcgcgaccuccggcuggccgcgaacgccaucugcagcgccgugccgguggacuggguccccaccucccgcaccacguggagcauccacgcccaccaccaguggaugaccaccgaggacaugcuguccguguggaaccggguguggaucgaggagaaccccuggauggaggacaagacccacaucagcuccuggggcgacguccccuaccucggcaagcgcgaggaccaguggugcggcagccugaucgggcugacggcccgggcgaccugggccaccaacauccagguggccaucaaccaggugcgccgccucaucggcaacgagaacuaccuggacuacaugaccuccaugaagcgguucaagaacgagagcgacccggagggggcccugugguga

SEQ ID NO: 8666 - RNA, 9879 nt, Artificial Sequence
  derived and/or modified CDS sequence (opt1) from DENV-1__GU131759__SS-prME
agcgugacgaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccuguccuucacguucaucaagaccaccuucagccugcacuacgccuggaagaccauggcgaugguccucuccaucgugagccuguucccccugugccucuccacgaccagccagaagaccaccuggcugcccgugcugcucggcucccuggggugcaagccgcugacgauguuccucaucgccgagaacaaggucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggaccaugaagaucaaggacgaggagcgggacgacacccucaccauccugcugaaggccacccuccuggccgugagcggcgucuacccgcuguccauccccgccacccucuucgugugguacuucuggcagaagaagaagcagcgcagcggggugcugugggacacccccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgcggugcugauguaccaggggaagcgccuggagcccuccugggccagcgugaagaaggaccucaucuccuacggcggcggguggcggcugcagggcagcuggaacacgggggaggagguccaggugaucgccguggagcccggcaagaaccccaagaacguccagaccgcccccgggaccuucaagaccuccgagggcgaggugggcgccaucgcgcuggacuucaagcccgggacgagcggcagccccaucgugaaccgcgaggggaagaucgucggccucuacggcaacgggguggugaccaccuccggcaccuacgucagcgccaucgcccaggccaaggcgucccaggaggggccccugccggagaucgaggacgagguguuccggaagcgcaaccugacgaucauggaccuccaccccggcagcgggaagacccggcgcuaccugcccgccaucgugcgggaggccaucaagcgcaagcugcggacccucauccuggccccgacccgcgucguggccuccgagauggcggaggcccugaagggcaugcccauccgcuaccagacgaccgccgucaagagcgagcacaccggcaaggagaucgucgaccucaugugccacgccaccuucacgaugcggcugcugucccccgugcgcgugcccaacuacaacaugaucaucauggacgaggcccacuucaccgacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccccgccggugccugaagccggucauccucaaggacgggcccgagcgcgugauccuggccggccccaugcccgucacgguggccuccgccgcgcagcggcgcgggcggaucggccgcaaccacaacaaggagggcgaccaguacaucuacauggggcagccgcugaacaacgacgaggaccacgcccacuggaccgaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccggucuggcucagccacaagguggccuccgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacgcugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagcccgaccgccagcggaccccgcaggacaaccagcucgccuacgucgugaucgggcugcuguucaugauccucacgguggccgcgaacgagaugggccugcuggagaccaccaagaaggaccucgggaucggccacgccgccgucgagaaccaccaccacgccgccaugcuggacguggaccugcaccccgcguccgccuggacccucuacgccguggccacgaccaucaucacccccaugaugcgccacaccaucgagaacacgaccgccaacaucagccugaccgcgaucgccaaccaggccgccauccugauggggcucgacaagggcuggccgaucuccaagauggacaucggcgucccccugcuggcgcucgggugcuacagccaggugaacccccugacccugacggccgccgugcucaugcuggucgcccacuacgccaucaucggccccgggcugcaggcgaaggccacccgggaggcccagaagcgcaccgccgccggcaucaugaagaacccgaccguggacgggaucguggcgaucgaccucgaccccgucguguacgacgccaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgccgugagcauggcgaacaucuuccgggggagcuaccuggccggcgccggccucgccuucucccugaugaagucccucgggggcgggcgccgggggaccggggcgcagggcgagacccucggcgagaaguggaagcgccagcugaaccagcuguccaagagcgaguucaacaccuacaagcgguccgggaucauggaggucgaccgcagcgaggccaaggagggccucaagcgcggggagacgaccaagcacgccgugucccgcggcaccgccaagcugcggugguucguggagcgcaaccuggucaagccggaggggaaggugaucgaccucggcugcggccgcggcggguggagcuacuacugcgccgggcugaagaaggugaccgaggucaagggguacacgaagggcgggcccggccacgaggagcccauccccauggcgaccuacggguggaaccuggugaagcugcacuccggcaaggacguguucuucaucccgcccgagaagugcgacacccuccugugcgacaucggggagagcucccccaaccccaccaucgaggagggccgcacgcugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgccgugaacaugaccucccgcaugcuccugaaccgguucacgauggcccaccgcaagccgaccuacgagcgcgacguggaccugggggccggcacccggcacgucgccguggagcccgagguggcgaaccucgacaucaucggccagcgcaucgagaacaucaagcacgagcacaagagcaccuggcacuacgacgaggacaaccccuacaagacgugggccuaccacggguccuacgaggucaagcccagcggcagcgccuccagcauggugaacggggucgugaagcugcugaccaagccgugggacgugauccccauggucacccagaucgccaugaccgacacgacccccuucggccagcagcggguguucaaggagaagguggacacccgcacccccaaggccaagcgggggacggcgcagaucauggaggucaccgccaaguggcucuggggcuuccugucccgcaacaagaagccgcggaucugcacccgcgaggaguucacccggaaggugcgcagcaacgccgccaucggcgcgguguucgucgacgagaaccaguggaacuccgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggcgaagaucacggacaucauggagcccgagcacgcccugcuggccaaguccaucuucaagcucaccuaccagaacaaggugguccgcgugcagcggccggccaagaacgggaccgugauggacgucaucagccgccgcgaccagcggggcuccggccaggugggcaccuacggccugaacacguucaccaacauggaggcccagcugauccgccagauggagagcgaggggaucuucucccccagcgagcucgagacccccaaccuggcgggccgggugcuggacuggcucgagaagcacggggucgagcgccugaagcggauggccaucuccggcgacgacugcguggugaagcccaucgacgaccgcuucgccaccgcccugacggcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcgcgggugucccagggcgccggguggagccuccgcgagaccgccugccugggcaaguccuacgcccagauguggcagcugauguacuuccaccggcgcgaccuccggcuggcggccaacgccaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugacggcgcgggccaccugggccaccaacauccaggucgccaucaaccaggugcgccgccucaucggcaacgagaacuaccuggacuacaugaccuccaugaagcgguucaagaacgagagcgacccggagggggcccugugguga

SEQ ID NO: 8667 - RNA, 9879 nt, Artificial Sequence
  derived and/or modified CDS sequence (opt1) from DENV-1__GU131761__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagauccaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcguggagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8668 - RNA, 9879 nt, Artificial Sequence
  derived and/or modified CDS sequence (opt1) from DENV-1__GU131762__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccaugagccuguccaugacgugcaucgccguggggcuggucacccucuaccugggcgugauggugcaggccgacagcgggugcgucaucaacuggaagggccgggagcugaagugcgggagcggcaucuucgugaccaacgaggugcacaccuggacggagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacccagacggccggccccuggcaccucgggaagcuggagcuggacuucgaccucugcgagggcaccaccguggucguggacgagcacugcggcaaccgggggccgagccugcgcaccacgaccgugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugacgggcacccucgccguguucuuccugcugaucauggggcagcucaccuggaacgaccugauccggcugugcaucauggucggcgcgaacgccuccgaccgcauggggaugggcaccacguaccucgcccugauggccaccuucaagaugcgcccgauguucgccgugggccuccuguuccggcgccugaccagccgggaggugcugcuccugaccaucgggcugucccucgucgcgagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacgcugaccauccugcucaaggccacccugcuggccgugagcggcguguacccgcucuccauccccgccacccuguuccugugguacuucuggcagaagaagaagcagcgcagcgggguccucugggacacccccagcccgcccgagguggagcgggccgugcuggacgacggcaucuaccgcaucaugcagcggggccugcuggggcgcagccaggucggcguggggguguuccaggagaacgucuuccacacgauguggcacgugacccggggcgcggugcucauguaccaggggaagcgccuggagcccuccugggccagcgucaagaaggaccugaucuccuacggcggcggguggcggcuccagggcagcuggaacaccggggaggagguccaggugaucgccgucgagcccggcaagaaccccaagaacgugcagaccgcccccgggacguucaagaccuccgagggcgaggugggcgccaucgcgcuggacuucaagcccgggaccagcggcagccccaucgucaaccgcgaggggaagaucgugggccuguacggcaacgggguggucaccacguccggcaccuacgugagcgccaucgcccaggccaaggcgucccaggaggggccccucccggagaucgaggacgagguguuccggaagcgcaaccugaccaucauggaccugcaccccggcagcgggaagacccggcgcuaccuccccgccaucguccgggaggccaucaagcgcaagcugcggacgcugauccucgccccgacccgcgugguggccuccgagauggcggaggcccugaagggcaugcccauccgcuaccagaccaccgccgucaagagcgagcacacgggcaaggagaucguggaccugaugugccacgccaccuucaccaugcggcuccugucccccgugcgcguccccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccguggaggccuucccccagagcaacgccgucauccaggacgaggagcgggacaucccggagcgcuccuggaacagcggguacgaguggaucaccgacuuccccggcaagacggugugguucgugcccuccaucaagagcggcaacgacaucgccaacugccugcggaagaacgggaagcgcgucauccagcucucccggaagaccuucgacaccgaguaccagaagaccaagaacaacgacugggacuacguggugacgaccgacaucagcgagaugggcgcgaacuuccgcgccgaccgggucaucgacccccgccggugccugaagccggugauccugaaggacgggcccgagcgcgugauccucgccggccccaugcccgucaccguggccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgggagaaguccgccgcgaucgacggggaguaccgccugcgcggcgaggcccggaagaccuucgucgagcucaugcgccgcggggaccugccgguguggcugagcuacaagguggccuccgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcguguacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacacgaucgagacccugaugcugcucgcccugaucgccgugcugaccggcggggucacccucuucuuccuguccggccgggggcugggcaagacgagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucacccccaugaugcgccacacgaucgagaacaccaccgccaacaucagccucaccgccaucgcgaaccaggccgccauccugauggggcuggacaagggcuggccgaucuccaagauggacaucggcgucccccuccuggcccuggggugcuacagccaggugaacccccucacgcugaccgcggccgugcugaugcucgucgcccacuacgccaucaucggccccgggcugcaggccaaggcgacccgggaggcccagaagcgcaccgccgccggcaucaugaagaacccgacgguggacgggaucguggccaucgaccuggaccccgucguguacgacgcgaaguucgagaagcagcucggccagaucaugcugcugauccucugcaccucccagauccugcugaugcgcaccaccugggcccucugcgagagcaucacgcuggccaccggcccccugaccacccucugggaggggucccccggcaaguucuggaacacgaccaucgccgugagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggcgaaggagggccugaagcgcggggagaccaccaagcacgccgugucccgcggcaccgccaagcuccggugguucguggagcgcaaccuggucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccacgaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggacgggcaacaucgucagcgcggugaacaugaccucccgcaugcugcucaaccgguucaccauggcccaccgcaagccgaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcuccugaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccucucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggccaagaucaccgacaucauggagcccgagcacgcgcuccuggccaaguccaucuucaagcugaccuaccagaacaaggugguccgcgugcagcggccggccaagaacgggaccgugauggacgucaucagccgccgcgaccagcggggcuccggccaggugggcacguacggccucaacaccuucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccacggcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccaccucccgcacgaccuggagcauccacgcccaccaccaguggaugaccaccgaggacaugcuguccgucuggaaccggguguggaucgaggagaaccccuggauggaggacaagacgcacaucagcuccuggggcgacgugcccuaccugggcaagcgcgaggaccaguggugcggcagccucaucgggcugaccgcccgggcgaccugggccaccaacauccaggucgccaucaaccaggugcgccgccugaucggcaacgagaacuaccucgacuacaugacguccaugaagcgguucaagaacgagagcgacccggagggggcccugugguga

SEQ ID NO: 8669 - RNA, 9879 nt, Artificial Sequence
  derived and/or modified CDS sequence (opt1) from DENV-1__GU131763__SS-prME
agcgugaccaugcugcucaugcugaugcccaccgcccuggccuuccaccucaccacccggggcggggagccccacaugaucgugaccaagcaggagcgggggaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggccucggcgaggucgacagcuucucccuggggcugcucugcaucagcaucaugaucgaggaggugaugcgcucccgguggagccgcaagaugcugauggccggcacccuggccguguuccuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgacccucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcgugguguccauccugcugagcagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggacgaugaagaucaaggacgaggagcgggacgacacccugaccauccuccugaaggccacccugcucgccaucagcggcguguacccgcuguccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgcgaggggaagaucgugggccuguacggcaacggggucgugacgaccuccggcaccuacgugagcgccaucgcccaggccaaggcgagccaggaggggccgcuccccgagaucgaggacgaggucuuccggaagcgcaaccugaccaucauggaccugcaccccggcuccgggaagacgcggcgcuaccucccggccaucgugcgggaggccaucaagcgcaagcugcggacccugauccucgcccccacccgcguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccugaaggacgggcccgagcgcgucauccucgccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcgcggcgaggcccggaagaccuucguggagcucaugcgccgcggggaccugcccguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccaccaugcucgacguggaccugcaccccgccagcgccuggacccuguacgcgguggccacgaccaucaucaccccgaugaugcgccacaccaucgagaacacgaccgccaacaucucccucaccgccaucgccaaccaggcggccauccugauggggcuggacaagggcuggcccaucagcaagauggacaucggcgucccccuccuggcccuggggugcuacucccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgagccagauccugcugaugcgcaccaccugggcgcucugcgaguccaucacccuggccacgggcccccugaccacccucugggaggggagcccgggcaaguucuggaacaccacgaucgccguguccauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcugagcaaguccgaguucaacaucuacaagcggagcgggaucauggaggucgaccgcuccgaggccaaggagggccugaagcgcggggagaccacgcgccacgcggugagccggggcaccgccaagcugcgcugguucguggagcggaaccucgucaagcccgaggggaaggugaucgaccugggcugcggccgcgggggcugguccuacuacugcgccgggcugaagaaggugaccgaggucaagggcuacaccaagggcgggcccggccacgaggagcccaucccgauggccacguacggguggaaccucgugaagcugcacagcggcaaggacguguucuucacgccgcccgagcggugcgacacccugcucugcgacaucggggaguccagccccaacccgaccaucgaggagggccgcacgcugcggguccugaagaugguggagcccuggcuccgcgggaaccaguucugcaucaagauccugaaccccuacaugcccuccguggucgagacccuggagcagaugcagcggaagcacggcggcaugcucgugcgcaacccgcugagccggaacuccacccacgagauguacugggugagcugcgggaccggcaacaucgucuccgccgugaacaugaccagccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagacgugggccuaccacgggagcuacgaggucaagccguccggcagcgcguccagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcccgcuggcuguggggcuuccucagccggaacaagaagccccgcaucugcacccgggaggaguucacccgcaaggugcgguccaacgcggccaucggcgccguguucgucgacgagaaccaguggaacagcgccaaggaggcgguggaggacgagcgcuucugggaccuggugcagaaggagcgggagcugcacaagcaggggaagugcgccacgugcgucuacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacccggaucaccgaggacgaccugcagaacgaggccaagaucacggacaucauggagccggagcacgcccuccuggcgaccagcaucuucaagcugaccuaccagaacaaggugguccgcgugcagcgccccgccaagaacgggaccgugauggacgucaucucccggcgcgaccagcggggcagcggccaggugggcacguacggccucaacaccuucaccaacauggaggcccagcugauccgccagauggaguccgaggggaucuuccugcccagcgagcucgagacccccaaccuggccgagcgggugcuggacuggcucgagaagcacggcgucgagcgccugaagcggauggccaucuccggggacgacugcguggugaagccgaucgacgaccgcuucgcgacggcccugaccgcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggccggcuggucccuccgcgagaccgcgugccugggcaagagcuacgcccagauguggcagcugauguacuuccaccggcgcgaccuccggcuggccgccaacgcgaucugcagcgccguccccguggacugggugcccaccucccgcacgaccuggagcauccacgcccaccaccaguggaugaccaccgaggacaugcuguccgucuggaacaagguguggaucgaggagaaccccuggauggaggacaagacgcacgugagcuccuggggcgacgucccguaccucgggaagcgggaggaccaguggugcggcagccugaucggccugaccgcccgcgccaccugggcguccaacauccagguggccaucaaccaggugcgccggcucaucgggaacgagaacuaccuggacuacaugaccagcaugaagcgcuucaagaacgagggcgaccccgagggggcccugugguga

SEQ ID NO: 8670 - RNA, 9879 nt, Artificial Sequence
  derived and/or modified CDS sequence (opt1) from DENV-1__GU131766__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaucgagcacggcaccaccgcgaccaucacgccccaggcccccacguccgagauccagcucaccgacuacggggcccugacccuggacugcagcccccgcaccggccucgacuucaacgagauggugcugcugacgaugaaggagaaguccuggcucguccacaagcagugguuccuggaccugccgcuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaucgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucaccagcaucgggaagcuggugcaccagaucuucggcacggccuacgggguccucuucuccggcgugagcuggaccaugaagaucgggaucggcgugcugcugaccuggcucggccugaacucccgcagcaccucccugagcaugacgugcaucgccgucgggcucgugacccuguaccugggcgugaugguccaggccgacuccgggugcgugaucaacuggaagggccgggagcucaagugcgggagcggcaucuucgugaccaacgagguccacaccuggacggagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagaugcgggacagcuacacccaggucugcgaccaccgccugauguccgcggccaucaaggacagcaaggccgugcacgccgacaugggcuacuggaucgaguccgagaagaacgagacguggaagcucgcccgggcgagcuucaucgaggugaagaccugcaucuggcccaagucccacacccuguggagcaacggcguccuggaguccgagaugaucauccccaagaucuacgggggcccgaucagccagcacaacuaccgccccggguacuucacccagacggccggccccuggcaccucgggaagcuggagcuggacuucgaccucugcgagggcaccaccgugguggucgacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugacgggcacccucgccguguuccugcugcucaucauggggcagcugaccuggaacgaccugauccggcucugcaucauggugggcgccaacgcgagcgaccgcauggggaugggcaccacguaccuggcccugauggccaccuucaagaugcgcccgauguucgccgucgggcuccuguuccggcgccugaccucccgggaggugcuccugcugaccaucgggcucagccugguggccuccgucgagcugcccaacagccucgaggagcugggcgacgggcuggcgaugggcaucaugauccucaagcugcugacggacuuccagucccaccagcucugcgccacccugcugagccucaccuucaucaagaccacgcugucccugcacuacgccuggaagaccauggccauggugcucagcaucgucucccugaucccccugugccucagcaccaccucccagaagacgaccuggcugcccgugcugcucggcagccuggggugcaagccgcugaccauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacgcucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacacgauguggcacgugacccggggcgccguccugauguaccaggggaagcgccuggagcccagcugggcguccgugaagaaggaccucaucagcuacggcggcggguggcggcugcagggcuccuggaacaccggggaggaggugcaggucaucgccguggagcccggcaagaaccccaagaacgugcagaccgcccccgggacguucaagacccccgagggcgaggucggcgccaucgcccuggacuucaagcccgggaccagcggcucccccaucgugaaccgcgaggggaagaucgugggccucuacggcaacggggucgugaccacgagcggcaccuacgugagcgcgaucgcccaggccaaggccucccaggaggggccgcugcccgagaucgaggacgaggucuuccggaagcgcaaccugaccaucauggaccuccaccccggcagcgggaagacccggcgcuaccugccggcgaucgugcgggaggccaucaagcgcaagcugcggacgcucauccuggcccccacccgcguggucgccuccgagauggccgaggcgcugaagggcaugcccauccgcuaccagaccaccgccgucaagagcgagcacacgggcaaggagaucguggaccucaugugccacgccaccuucaccaugcggcugcugucccccguccgcgugccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagacggugugguucguccccuccaucaagagcggcaacgacaucgccaacugccuccggaagaacgggaagcgcgugauccagcugucccggaagaccuucgacaccgaguaccagaagaccaagaacaacgacugggacuacguggucacgaccgacaucagcgagaugggcgccaacuuccgcgcggaccgggugaucgacccgcgccggugccugaagcccgugauccucaaggacgggcccgagcgcgucauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacgcagcgcgcccagaacgcccuggacaaccuggugaugcuccacaacagcgagcagggcgggcgggccuaccgccacgcgauggaggagcugcccgacaccaucgagacccugaugcuccuggcccugaucgccgugcucaccggcggggucacgcuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccacgaagaaggaccucgggaucggccacguggcggucgagaaccaccaccacgccaccaugcuggacguggaccugcaccccgccuccgccuggacccucuacgccguggcgaccacgaucaucaccccgaugaugcgccacaccaucgagaacaccacggccaacaucagccugaccgccaucgccaaccaggccgcgauccugauggggcucgacaagggcuggcccaucuccaagauggacaucggcgucccccugcuggcccucgggugcuacagccaggugaacccccugacccugaccgccgccgugcucaugcuggucgcgcacuacgccaucaucggcccggggcugcaggccaaggccacgcgggaggcccagaagcgcaccgcggccggcaucaugaagaaccccaccguggacgggaucguggccaucgaccucgaccccgucguguacgacgccaaguucgagaagcagcugggccagaucaugcugcucauccugugcaccucccagauccugcucaugcgcacgaccugggcccugugcgagagcaucacccuggcgaccggcccccucacgacccugugggagggguccccgggcaaguucuggaacaccaccaucgccgugagcauggccaacaucuuccggggguccuaccuggccggcgccggccucgcguucagccugaugaagucccucgggggcgggcgccgggggacgggggcccagggcgagacccucggcgagaaguggaagcgccagcugaaccagcuguccaagagcgaguucaacaucuacaagcgguccgggaucauggaggucgaccgcagcgaggccaaggagggccucaagcgcggggagaccacccgccacgccgugucccggggcacggcgaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccaccuacggguggaaccuggugaagcugcacuccggcaaggacguguucuucacgccgcccgagaagugcgacacccuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacgcucgagcagaugcagcgcaagcacggcggcaugcuggugcggaacccgcugucccgcaacagcacccacgagauguacuggguguccugcgggaccggcaacaucgucagcgccgugaacaugaccucccggaugcuccugaaccgcuucaccauggcccaccgcaagcccacguacgagaaggacguggaccugggggcgggcacccggcacgucgccguggagcccgagguggccaaccucgacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcugacgaagcccugggacgugauccccauggucacccagaucgcgaugaccgacaccacgcccuucggccagcagcggguguucaaggagaagguggacacccgcaccccgaaggccaagcgggggaccguccagaucauggaggugacggcccgcuggcucuggggcuuccugucccggaacaagaagccccgcaucugcacccgggaggaguucacccgcaaggugcggagcaacgccgccaucggcgcggucuucguggacgagaaccaguggaacuccgccaaggaggccguggaggacgagcgcuucugggaccuggucaagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggcgggcugggacacccggaucaccgaggacgaccuccagaacgaggccaagaucaccgacaucauggagccggagcacgcccugcuggccacguccaucuucaagcucaccuaccagaacaaggucgugcgcgugcagcggcccgccaagaacgggaccgucauggacgugaucagccgccgcgaccagcggggcuccggccaggugggcaccuacggccugaacacguucaccaacauggaggcgcagcugauccgccagauggagagcgaggggaucuuccuccccuccgagcuggagacccccaaccuggccgagcggguccucgacuggcuggagaaguacggcguggagcgccugaagcggauggccaucagcggggacgacugcguggucaagccgaucgacgaccgcuucgccaccgcccucacggcgcugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcccgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccaccagccgcaccacgugguccauccacgcgcaccaccaguggaugaccaccgaggacaugcucagcguguggaaccggguguggaucgaggagaaccccuggauggaggacaagacccacgucuccagcuggggcgacgugccguaccuggggaagcgcgaggaccaguggugcggcucccugaucggccucacggcccgggccaccugggccagcaacauccagguggccaucaaccagguccgccgccugaucgggaacgagaacuaccuggacuacaugaccuccaugaagcgguucaagaacgagggcgaccccgagggggcgcucugguga

SEQ ID NO: 8671 - RNA, 9879 nt, Artificial Sequence
  derived and/or modified CDS sequence (opt1) from DENV-1__GU131767__SS-prME
agcgugaccaugcugcugaugcugaugcccaccgcccuggccuuccaccucacgacccggggcggggagccccacaugaucgugagcaagcaggagcggggcaagagccugcuguucaagaccagcgugggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgucggccucgggcuggagacgcgcaccgagaccuggaugagcuccgagggcgccuggaagcagauccagcggguggagaccugggcccugcgccaccccggguucacggugaucgcccucuuccuggcccacgcgaucggcaccagcaucacccagaaggggaucaucuucauccugcucaugcuggucacccccuccauggccaugcggugcgugggcaucggcagccgcgacuucguggaggggcuguccggcgccacgugggucgacguggugcucgagcacgggagcugcgucaccaccauggccaaggacaagcccacccuggacaucgagcugcucaagacggaggugaccaaccccgccgugcugcggaagcugugcaucgaggcgaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaucacgugcgccaaguucaagugcgucaccaagcucgagggcaagaucgugcaguacgagaaccugaaguacagcgugaucgucaccgugcacaccggcgaccagcaccaggucgggaacgaguccacggagcacggcaccaccgccaccaucacgccccaggcgcccagcacggagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccagcggggccuccaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccucgugcagaucaaguacgagggcaccgacgcgcccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcgucuucacguccguggggaagcuggugcaccagaucuucggcaccgccuacgggguccuguucagcggcguguccuggaccaugaagaucgggaucggcgugcuccugaccuggcugggccucaacagccgcuccacgagccuguccaugaccugcaucgccgucgggcuggugacccucuaccugggcgugaugguccgggccgacagcgggugcgugaucaacuggaagggccgcgagcugaagugcgggagcggcaucuucgugaccaacgagguccacacguggaccgagcaguacaaguuccaggccgacuccccgaagcggcucagcgcggccaucggcaaggccugggaggagggggugugcggcauccgcuccgccacccggcuggagaacaucauguggaagcagaucagcaacgagcugaaccacauccuccuggagaacgacaugaagcugaccguggucgugggggacguggccggcauccucgcgcaggggaagaagaugauccgcccccagcccauggaguacaaguacuccuggaaguccuggggcaaggccaagaucaucggcgccgacguccagaacaccacguucaucaucgacgggcccaacaccccggagugccccgacgaccagcgggccuggaacaucugggagguggaggacuacggcuucgggaucuucaccaccaacaucuggcugaagcugcgcgacuccuacacccaggugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcaucuggcccaagagccacacccugugguccaacggcgugcucgagagcgagaugaucauccccaagaucuacgggggcccgaucucccagcacaacuaccggcccggguacuucacgcagaccgccggccccuggcaccuggggaagcuggagcucgacuucgaccugugcgagggcaccaccgucgugguggacgagcacugcggcaaccgcgggccgagccugcggacgaccaccgucaccggcaagaucauccacgaguggugcugccgcuccugcacgcugccgccccuccgguucaagggggaggacggcugcugguacgggauggagauccgccccgugaaggagaaggaggagaaccuggucaagagcauggucagcgccggcuccggcgagguggacagcuucucccucgggcugcugugcaucagcaucaugaucgaggaggugaugcggucccgcuggagccggaagaugcucaugaccggcacccuggccgucuucuuccugcucaucauggggcagcugaccuggaacgaccugauccgccucugcaucauggugggcgccaacgcguccgaccgcauggggaugggcacgaccuaccuggcccugauggccaccuucaagaugcggccgauguucgccgugggccuccuguuccgccggcugaccagccgcgagguccuccugcugacgaucgggcucucccugguggccagcgucgagcugcccaacucccucgaggagcugggcgacgggcuggcgaugggcaucaugauccucaagcugcugaccgacuuccagagccaccagcucugggccacccugcugucccucaccuucauccggacgaccuucagccugcacuacgccuggaagaccauggccauggugcuguccaucgugagccucuucccccugugccuguccaccacgagccagaagaccaccuggcuccccguccugcugggcucccucgggugcaagccgcugaccauguuccugaucgcggagaacaagaucuggggccgcaagagcuggccccucaacgaggggaucauggccgugggcaucgugagcauccugcuguccagccuccugaagaacgacgucccccuggccgggccccucaucgccggcggcaugcugaucgccugcuacgugaucuccgggagcuccgcggaccugagccucgagaaggccgccguggucuccugggaggaggaggccgagcacagcggcgccucccacaacauccugguggaggugcaggacgacgggacgaugaagaucaaggacgaggagcgggacgacacccugaccauccuccugaaggcgacccugcucgccgucagcggcguguacccgcuguccauccccgccacccuguucgugugguacuucuggcagaagaagaagcagcgcagcgggguccucugggacacgcccagcccgcccgagguggagcgggccgugcuggacgacggcaucuaccgcaucaugcagcggggccugcuggggcgcagccaggucggcguggggguguuccaggagaacgucuuccacaccauguggcacgugacccggggcgccgugcucauguaccaggggaagcgccuggagcccuccugggcgagcgucaagaaggaccugaucuccuacggcggcggguggcggcuccagggcagcuggaacaccggggaggagguccaggugaucgccgucgagcccggcaagaaccccaagaacgugcagacggcccccgggaccuucaagaccuccgagggcgaggugggcgccaucgcccuggacuucaagcccgggaccagcggcagccccaucgucaaccgcgaggggaagaucgugggccuguacggcaacgggguggucacgaccuccggcaccuacgugagcgcgaucgcccaggccaaggccucccaggaggggccccucccggagaucgaggacgagguguuccggaagcgcaaccugaccaucauggaccugcaccccggcagcgggaagacgcggcgcuaccuccccgcgaucguccgggaggccaucaagcgcaagcugcgcacccugauccucgccccgacccgggugguggccuccgagauggccgaggcgcugaagggcaugcccauccgcuaccagaccacggccgucaagagcgagcacaccggcaaggagaucguggaccugaugugccacgccaccuucaccaugcggcuccugucccccgugcgcguccccaacuacaacaugaucaucauggacgaggcccacuucacggacccgagcuccaucgccgcgcggggguacaucagcacccgcgugggcaugggggaggccgccgccaucuucaugaccgccacgccgcccggcuccguggaggcguucccccagagcaacgccgucauccaggacgaggagcgggacaucccggagcgcuccuggaacagcggguacgaguggaucacggacuuccccggcaagaccgugugguucgugcccuccaucaagagcggcaacgacaucgccaacugccugcggaagaacgggaagcgcgucauccagcucucccggaagaccuucgacaccgaguaccagaagacgaagaacaacgacugggacuacguggugaccaccgacaucagcgagaugggcgccaacuuccgcgcggaccgggucaucgacccccgccggugccugaagccggugauccugaaggacgggcccgagcgcgucauccucgccggccccaugcccgugaccguggccuccgccgcccagcggcgcgggcggaucggccgcaaccacaacaaggagggcgaccaguacaucuacauggggcagccgcugaacaacgacgaggaccacgcgcacuggacggaggccaagaugcugcucgacaacaucaacacccccgagggcaucauccccgcccuguucgagcccgagcgcgagaaguccgccgccaucgacggggaguaccggcugcgcggcgaggcgcggaagaccuucgucgagcucaugcgccgcggggaccugccgguguggcugagcuacaagguggccuccgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcacguacuccgacccccucgcccugcgggaguucaaggaguucgccgcgggccgccggagcguguccggggaccugauccucgagaucggcaagcugccccagcaccugacccagcgcgcccagaacgcccucgacaaccuggucaugcugcacaacagcgagcagggcgggcgggccuaccgccacgcgauggaggagcucccggacaccaucgagacccugaugcugcucgcccugaucgccgugcugacgggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagcccgaccgccagcggaccccgcaggacaaccagcuggccuacguggugaucgggcuccuguucaugauccugaccgucgccgccaacgagaugggccuccuggagacgaccaagaaggaccuggggaucggccacguggcgguggagaaccaccaccacgccgccaugcucgacgucgaccugcaccccgccuccgccuggacccuguacgcgguggccaccacgaucaucacccccaugaugcgccacaccaucgagaacaccacggccaacaucagccucaccgccaucgccaaccaggcggccauccugauggggcuggacaagggcuggccgaucuccaagauggacaucggcgugccccuccuggcccuggggugcuacagccaggucaacccccucacccugaccgccgcggugcugaugcucguggcccacuacgccaucaucggccccgggcugcaggccaaggccacgcgcgaggcgcagaagcggaccgccgccggcaucaugaagaacccgaccgucgacgggaucguggccaucgaccuggaccccguggucuacgacgccaaguucgagaagcagcucggccagaucaugcugcugauccucugcaccucccagauccugcugaugcgcacgaccugggcgcucugcgagagcaucacccuggccaccggcccccugacgacccucugggaggggucccccggcaaguucuggaacaccaccaucgccgugagcauggccaacaucuuccgggggagcuaccuggccggcgcgggccuggccuucucccucaugaagucccucgggggcgggcgccgggggacgggggcccagggcgagacccugggcgagaaguggaagcgccagcucaaccagcuguccaagagcgaguucaacaccuacaagcgguccgggaucauggagguggaccgcagcgaggccaaggagggccugaagcgcggggagaccacgaagcacgcggucucccgcggcaccgccaagcuccggugguucguggagcgcaaccuggugaagccggaggggaaggucaucgaccugggcugcggccgcggcggguggagcuacuacugcgccgggcugaagaaggugaccgaggugaagggguacaccaagggcggccccggccacgaggagcccauccccauggccacguacggguggaaccucgucaagcugcacuccggcaaggacguguucuucaucccgcccgagaagugcgacacccugcucugcgacaucggggagagcucccccaaccccaccaucgaggagggccgcacccugcgggugcugaagauggucgagccguggcuccgcgggaaccaguucugcaucaagauccugaaccccuacaugcccagcgugguggagacgcuggagcagaugcagcggaagcacggcggcaugcucguccgcaacccccugucccggaacagcacccacgagauguacuggguguccugcgggaccggcaacaucgugagcgccgucaacaugaccucccgcaugcugcucaaccgcuucaccauggcgcaccggaagccgacguacgagcgcgacguggaccugggggccggcacccggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggucaagcccagcggcagcgcguccagcauggugaacgggguggucaagcuccugacgaagccgugggacgugauccccauggugacccagaucgccaugaccgacaccacgcccuucggccagcagcgggucuucaaggagaagguggacacccgcacccccaaggccaagcgggggaccgcccagaucauggaggugacggccaaguggcuguggggcuuccucucccgcaacaagaagccgcggaucugcacccgcgaggaguucacccggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacacggccggcugggacacccggaucaccgaggacgaccugcagaacgaggccaagaucaccgacaucauggagcccgagcacgcccuccuggcgaaguccaucuucaagcugacguaccagaacaagguggugcgcguccagcgcccggccaagaacgggaccgugauggacgugaucagccggcgcgaccagcggggcuccgggcaggucggcaccuacggccucaacaccuucacgaacauggaggcccagcugauccgccagauggagagcgaggggaucuucucccccagcgagcuggagacccccaaccucgccggccgggugcuggacuggcuggagaagcacgggguggagcgccucaagcggauggccaucuccggcgacgacugcgucgugaagcccaucgacgaccgcuucgcgaccgcccugaccgcccugaacgacauggggaaggugcggaaggacaucccgcagugggagcccagcaagggcuggaacgacuggcagcagguccccuucugcagccaccacuuccaccagcucaucaugaaggacggccgcgagaucguggugcccugccggaaccaggacgagcuggucgggcgcgcccgggugucccagggcgccggguggagccugcgcgagacggcgugccucggcaaguccuacgcccagauguggcagcugauguacuuccaccggcgcgaccugcggcucgccgccaacgcgaucugcagcgccgugccggucgacugggugcccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugcccuaccugggcaagcgcgaggaccaguggugcggcagccucaucgggcugaccgcccgcgccacgugggcgaccaacauccagguggccaucaaccagguccggcgccugcucggcaacgagaacuaccuggacuacaugaccuccaugaagcgguucaagaacgagagcgacccggagggggcccugugguga

SEQ ID NO: 8672 - RNA, 9879 nt, Artificial Sequence
  derived and/or modified CDS sequence (opt1) from DENV-1__HM181967__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacauggccguggagaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggucaacccccucacccugacggcggccgugcugaugcucguggcccacuacgccaucaucggcccggggcugcaggccaaggcgacccgggaggcccagaagcgcaccgccgccggcaucaugaagaaccccaccgucgacgggaucguggccaucgaccuggaccccguggucuacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagacgaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugaccgaggugaagggcuacacgaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugaccucccgcaugcugcucaaccgguucacgauggcccaccgcaagcccaccuacgagcgggacguggaccugggggccggcacccgccacguggccgucgagcccgagguggccaaccuggacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggucaagcuccugaccaagcccugggacgugauccccauggugacccagaucgccaugaccgacacgacccccuucggccagcagcgcgucuucaaggagaagguggacacccggaccccgaaggccaagcgcgggacggcccagaucauggaggugaccgcgaaguggcuguggggcuuccucucccggaacaagaagccccgcaucugcacccgggaggaguucacccgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaagguggugcggguccagcgccccgccaagaacgggaccgugauggacgugaucagccggcgcgaccagcggggcuccgggcaggucggcaccuacggccucaacacguucaccaacauggaggcccagcugauccgccagauggagagcgaggggaucuucucccccagcgagcuggagacccccaaccucgccgagcgggugcuggacuggcuggagaaguacggcguggagcgccucaagcggauggcgaucuccggggacgacugcgucgugaagccgaucgacgaccgcuucgccaccgcccugacggcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccgugcccgucgacuggauccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccuggggaagcgggaggaccaguggugcggcagccucaucggccugacggcccgcgcgaccugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8673 - RNA, 9879 nt, Artificial Sequence
  derived and/or modified CDS sequence (opt1) from DENV-1__GU131768__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaacuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgucaugcugcacaacagcgagcagggcgggcgggccuaccgccacgccauggaggagcugcccgacacgaucgagacccucaugcugcuggcgcucaucgccgugcugaccggcggggugacccuguucuuccucuccggccgggggcugggcaagaccagcaucggccugcucugcgucauggccuccagcgugcugcuguggauggccuccguggagccccacuggaucgccgcgagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggccguggagaaccaccaccacgcgacgaugcuggacgucgaccuccaccccgccuccgccuggacccuguacgccguggccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggucaacccccugacccucaccgccgccgugcugaugcugguggcccacuacgcgaucaucggcccggggcuccaggccaaggccacccgggaggcccagaagcgcacggccgcgggcaucaugaagaaccccaccgucgacgggaucguggccaucgaccuggaccccguggucuacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggugagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcaccgccaagcugcgcugguucguggagcggaaccuggugaagcccgaggggaaggucaucgaccucggcugcggccgcgggggcuggagcuacuacugcgcggggcugaagaaggugacggaggugaagggcuacaccaagggcgggcccggccacgaggagcccaucccgauggccaccuacggguggaaccuggucaagcuccacuccggcaaggacguguucuucacgccgcccgagaagugcgacacgcugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggacgggcaacaucgugagcgccgucaacaugaccucccggaugcugcugaaccgcuucaccauggcccaccgcaagcccaccuacgagcgggacguggaccucggggccggcacgcgccacguggcggucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucaccaagcccugggacgugauccccauggugacgcagaucgccaugaccgacaccacccccuucggccagcagcgcgucuucaaggagaagguggacacgcggaccccgaaggcgaagcgcgggaccgcccagaucauggaggugaccgcccgguggcuguggggcuuccugucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccucgugaagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgcgggcugggacacgcgcaucaccgccgacgaccugcagaacgaggccaagaucaccgacaucauggagccggagcacgcccugcucgccaccuccaucuucaagcugacguaccagaacaagguggugcggguccagcgccccgcgaagaacgggaccgugauggacgugaucagccgccgggaccagcgcggcuccgggcaggucggcaccuacggccugaacaccuucacgaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagacggccugccucggcaagagcuacgcgcagauguggcagcugauguacuuccaccgccgggaccugcgccucgccgccaacgccaucugcuccgcggugcccgucgacugggugcccaccagccggaccaccugguccauccacgcccaccaccaguggaugacgaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccaccugggccagcaacauccaggucgcgaucaaccaggugcgccggcugaucgggaacgagaacuaccucgacuacaugacguccaugaagcgcuucaagaacgagggcgaccccgagggggcccugugguga

SEQ ID NO: 8674 - RNA, 9879 nt, Artificial Sequence
  derived and/or modified CDS sequence (opt1) from DENV-1__GU131770__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagauccgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacugcgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggacaagcagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcggcggguggagcuacuacugcgccgggcugaagaaggugacggaggucaagggguacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacgggaccgugauggacgucaucagccgccgggaccagcgcggcuccggccaggugggcacguacggccucaacaccuucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggccaucuccggggacgacugcguggugaagccgaucgacgaccgguucgcgacggcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgcgaggaccaguggugcggcagccucaucggccugaccgcccgggccaccugggcgaccaacauccagguggccaucaaccagguccgccggcugaucgggaacgagaacuaccucgacuacaugaccuccaugaagcgcuucaagaacgagagcgaccccgagggcgcccugugguga

SEQ ID NO: 8675 - RNA, 9879 nt, Artificial Sequence
  derived and/or modified CDS sequence (opt1) from DENV-1__GU131773__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgagaagcgguccguggcccucgcgccccacgugggccuggggcuggagacgcggaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcaugaccaagcuggagggcaagaucgugcaguacgagaaccucaaguacagcgucaucgugaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcugguccacaagcagugguuccuggaccucccccugcccuggaccagcggggccagcaccucccaggagacguggaaccggcaggaccugcucgugaccuucaagaccgcccacgcgaagaagcaggagguggucgugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggugcaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgccuggaacaucugggaggucgaggacuacggcuucgggaucuucaccaccaacaucuggcugaagcuccgggacuccuacacccaggugugcgaccaccgccugaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccguggucguggacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgucaaggagaaggaggagaaccucgucaagagcauggugagcgccggcuccggcgaggucgacagcuuccugcuggggcuccugugcaucuccaucaugaucgaggaggugaugcggagccgcuggucccggaagaugcugaugaccggcacccucgccguguucuuccugcugaucauggggcagcucaccuggaacgaccugauccgccugugcaucauggucggcgccaacgcgagcgaccgcauggggaugggcacgaccuaccucgcccugauggccaccuucaagaugcggccgauguucgccgugggccugcuguuccgccggcugaccucccgcgaggugcugcuccugacgaucgggcugagccucgucgccuccguggagcugcccaacagccuggaggagcucggcgacgggcuggcgaugggcaucaugauccugaagcuccugaccgacuuccaguccuaccagcugugggccacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgcggagaacaagaucuggggccggaaguccuggccccugaacgaggggaucauggccgucggcaucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggacgaugaagaucaaggacgaggagcgcgacgacacccugaccauccugcucaaggcgacccugcuggccguguccggcguguacccgcucagcauccccgccacccuguucgucuggcacuucuggcagaagaagaagcagcgguccggggugcugugggacacgcccagcccgcccgagguggagcgcgccguccuggacgacggcaucuaccggaucaugcagcgcggccuccuggggcggucccaggugggcgugggggucuuccaggagaacguguuccacaccauguggcacgugacccgcggcgccguccugauguaccaggggaagcggcucgagcccagcugggcguccgugaagaaggaccugaucagcuacggcggcggguggcgcuuccagggcuccuggaacaccggggaggaggugcaggucaucgccguggagcccggcaagaaccccaagaacgugcagacggcccccgggaccuucaagacccccgagggcgaggucggcgccaucgcccuggacuucaagcccgggaccagcggcucccccaucgugaaccgggaggggaagaucgugggccucuacggcaacggggucgugacgaccagcggcaccuacgugagcgcgaucgcccaggccaaggccucccaggaggggccgcugcccgagaucgaggacgaggucuuccgcaagcggaaccugaccaucauggaccuccaccccggcagcgggaagacgcgccgguaccugccggcgaucgugcgcgaggccaucaagcggaagcugcgcacccucauccuggcccccacccgcguggucgccuccgagauggccgaggcgcugaagggcaugcccauccgguaccagaccacggccgucaagagcgagcacaccggcaaggagaucguggaccucaugugccacgccaccuucaccaugcgccugcugucccccguccgggugccgaacuacaacaugaucaucauggacgaggcccacuucacggaccccagcuccaucgccgcgcgcggguacaucagcacccgggugggcaugggggaggccgccgccaucuucaugaccgccacgccgcccggcuccauggaggcguucccgcagagcaacgccgucauccaggacgaggagcgcgacauccccgagcgguccuggaacagcggguacgaguggaucacggacuuccccggcaagaccgugugguucgugcccuccaucaaggccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgcgaacuuccgggccgaccgcgucaucgacccgcggcgcugccugaagcccgugauccucaaggacgggcccgagcgggugauccuggccggccccaugccggucaccguggccagcgccgcgcagcgccgggggcgcaucggccggaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccgccuccggggcgaggcccgcaagaccuucgucgagcugaugcggcgcggggaccugcccguguggcucagcuacaagguggccuccgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgcggccggccggcgcuccgugagcggggaccucauccuggagaucggcaagcugccgcagcaccucacccagcgggcccagaacgcccuggacaaccuggucaugcuccacaacuccgagcagggcgggcgcgcguaccggcacgccauggaggagcugcccgacaccaucgagacccugaugcuccuggcccugaucgccgugcucacgggcggggugacccuguucuuccugagcggcaaggggcucggcaagaccuccaucggccugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucgggcugcuguucaugauccucaccgucgccgcgaacgagaugggccugcuggagacgaccaagaaggaccucgggaucggccacguggccguggagaaccaccaccacgccgccaugcuggacgucgaccugcaccccgccagcgcguggacccucuacgccguggccaccacgaucaucaccccgaugaugcgccacaccaucgagaacaccacggccaacaucucccugaccgccaucgcgaaccaggccgccauccugauggggcucgacaagggcuggcccaucagcaagauggacaucggcgugccccugcuggcccucgggugcuacucccaggucaacccccugacccugaccgcggccgugcucaugcugguggcccacuacgccaucaucggcccggggcugcaggccaaggcgacgcgggaggcccagaagcgcaccgccgccggcaucaugaagaaccccaccaucgacgggaucgucgccaucgaccucgaccccgugguguacgacgcgaaguucgagaagcagcugggccagaucaugcugcucauccugugcaccagccagauccugcucaugcgcacgaccugggcccugugcgaguccaucacccuggccaccggcccccucacgacccugugggaggggagcccgggcaaguucuggaacaccaccaucgccgucuccauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcugagcaaguccgaguucaacaccuacaagcggagcgggaucauggagguggaccgcuccgaggcgaaggagggccucaagcgcggggagaccacgaagcacgccgugagccgcggcaccgccaagcugcggugguucgucgagcgcaaccuggugaagcccgaggggaaggugaucgaccugggcugcggccgcgggggcugguccuacuacugcgccgggcucaagaaggucaccgaggugaagggcuacaccaagggcggccccggccacgaggagcccaucccgauggccacguacggguggaaccuggugaagcugcacagcggcaaggacgucuucuucaucccgcccgagaagugcgacacccuccugugcgacaucggggaguccagccccaacccgaccaucgaggagggccgcacccugcgggugcucaagaugguggagcccuggcugcgcgggaaccaguucugcaucaagauccugaaccccuacaugcccuccgucguggagacgcucgagcagaugcagcggaagcacggcggcaugcuggugcgcaacccgcugagccggaacuccacccacgagauguacugggucagcugcgggaccggcaacaucguguccgcggugaacaugaccagccgcaugcuccugaaccgguucaccauggcccaccgcaagcccacguacgagcgcgacgucgaccugggggccggcacccggcacguggccguggagcccgaggucgccaaccucgacaucaucggccagcgcaucgagaacaucaagcacgagcacaaguccaccuggcacuacgacgaggacaaccccuacaagaccugggcguaccacgggagcuacgaggugaagccguccggcagcgccuccagcauggugaacggggucgugaagcugcugacgaagcccugggacgucauccccauggugacccagaucgccaugaccgacaccacgcccuucggccagcagcggguguucaaggagaaggucgacacccgcaccccgaaggccaagcgggggaccgcccagaucauggaggugacggcgcgcuggcucuggggcuuccugagccggaacaagaagccccgcaucugcacccgggaggaguucacccgcaaggugcgguccaacgccgccaucggcgccgucuucguggacgagaaccaguggaacagcgcgaaggaggccguggaggacgaccgcuucugggaccugguccaccgggagcgcgagcuccacaagcaggggaagugcgcgaccugcguguacaacaugaugggcaagcgggagaagaagcugggggaguucggcaaggccaaggggucccgcgccaucugguacauguggcugggcgcgcgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacacggccggcugggacacccgcaucaccgaggacgaccuccagaacgaggccaagaucaccgacaucauggagccggagcacgcgcugcuggccaagagcaucuucaagcucacguaccagaacaaggucgugcgggugcagcgccccgccaagaacgggaccgucauggacgugaucucccgccgggaccagcgcggcagcggccagguggggaccuacggccugaacaccuucacgaacauggaggcccagcugauccggcagauggaguccgaggggaucuuccuccccaacgagcuggagacccccaaccuggccggccgcguccucgacuggcuggagaaguacgggguggagcggcugaagcgcauggcgaucagcggcgacgacugcguggucaagccgaucgacgaccgguucgccaccgcccucaccgcccugaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcucguggggcgggcccgcgucucccagggcgcgggguggagccugcgggagacggccugccugggcaaguccuacgcccagauguggcagcucauguacuuccaccgccgggaccugcgccuggccgcgaacgccaucugcagcgccgugcccguggacuggguccccaccagccggaccaccugguccauccacgcccaccaccaguggaugacgaccgaggacaugcucagcguguggaaccgcguguggaucgaggagaaccccuggauggaggacaagacccggaucuccagcugggaggacgucccguaccuggggaagcgcgaggaccaguggugcggcucccugaucggccucaccgcccgcgcgacgugggccaccaacauccagguggccaucaaccaggugcggcgccugaucgggaacgagaacuacagcgacuacaugaccuccaugaagcgguucaagaacgagagcgagcccgagggcgcccugugguga

SEQ ID NO: 8676 - RNA, 9879 nt, Artificial Sequence
  derived and/or modified CDS sequence (opt1) from DENV-1__GU131775__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucguggugaccguccacacgggcgaccagcaccagguggggaacgagagcaccgagcacggcaccaccgcgaccaucacgccccaggcccccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgggaaggcccugaagcucagcugguucaagaagggcuccagcaucgggaagauguucgaggccaccgcccgcggcgcccggcgcauggcgauccugggggacacggccugggacuucggcuccgugggcggggucuucaccagcgugggcaagcuggugcaccagaucuucgggaccgccuacggcguccucuucuccggggugagcuggaccaugaagaucggcaucggcgugcugcugacguggcucgggcugaacucccgcagcaccucccugagcaugaccugcaucgccgucggccucgugacccuguaccugggggugaugguccaggccgacuccggcugcgugaucaacuggaaggggcgggagcucaagugcggcagcggcaucuucgugacgaacgagguccacaccuggaccgagcaguacaaguuccaggcggacagcccgaagcgccuguccgccgccaucgggaaggccugggaggagggcgugugcgggauccggagcgccacccgccuggagaacaucauguggaagcagaucuccaacgagcucaaccacauccugcuggagaacgacaugaaguucaccguggucgugggcgacguggucgggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggagguggaggacuacggguucggcaucuucaccacgaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagaccugcaucuggcccaagucccacacgcuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacggugguggucgacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgugaaggagaaggaggagaaccuggucaaguccauggugagcgccggcagcggggagguggacuccuucagccucggccugcugugcaucuccaucaugaucgaggaggucaugcgcagccgguggucccgcaagaugcucaugaccgggacccuggccguguuccugcuccugaucaugggccagcugacguggaacgaccucauccggcugugcaucauggugggggccaacgcgagcgaccgcaugggcaugggcaccaccuaccuggcccucauggccaccuucaagaugcgcccgauguucgccgucgggcugcuguuccggcgccucacgucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacccugcucagccugacguucaucaagaccacccugucccuccacuacgccuggaagaccauggccauggugcugagcaucgucucccuguucccccucugccugagcacgaccucccagaagaccaccuggcugcccgugcuccuggggagccugggcugcaagccgcucacgauguuccugaucaccgagaacaagaucugggggcgcaaguccuggccccugaacgagggcaucauggcggugggggucgugagcauccuccugagcucccugcucaagaacgacgugccccuggccggcccccugaucgccggcgggaugcucaucgccugcuacgucaucagcggcuccagcgccgaccugucccuggagaaggcggccgaggugagcugggaggaggaggccgagcacuccggggccagccacaacauccucguggagguccaggacgacggcaccaugaagaucaaggacgaggagcgggacgacacccugaccauccugcucaaggccacgcugcuggcgguguccgggguguacccgcucagcauccccgccacccuguucgucugguacuucuggcagaagaagaagcagcgcuccggcgugcugugggacacccccagcccgcccgagguggagcgggccguccuggacgacggcaucuaccgcaucaugcagcgggggcuccugggccgcucccaggugggggugggcgucuuccaggagaacguguuccacaccauguggcacgugacgcgcggggccguccugauguaccagggcaagcgccucgagcccagcugggccuccgugaagaaggaccugaucagcuacggcgggggcuggcggcugcagggguccuggaacaccggcgaggaggugcaggucaucgcgguggagcccgggaagaaccccaagaacgugcagaccgcccccggcaccuucaagacgcccgagggcgaggucggggccaucgcccucgacuucaagcccggcaccagcgggucccccaucgugaaccgcgagggcaagaucgugggccuguacgggaacggcgucgugaccaccagcgggacguacgugagcgccaucgcgcaggccaaggccucccaggagggcccgcugcccgagaucgaggacgaggucuuccggaagcgcaaccucaccaucauggaccugcaccccgggagcggcaagacccggcgcuaccugccggccaucgugcgggaggcgaucaagcgcaagcuccggacccugauccuggcccccacgcgcguggucgccuccgagauggccgaggcccucaagggcaugcccauccgcuaccagaccaccgcggucaagagcgagcacaccgggaaggagaucguggaccugaugugccacgccacguucaccaugcggcugcucucccccguccgcgugccgaacuacaacaugaucaucauggacgaggcccacuucaccgaccccagcuccaucgccgcccggggcuacaucagcacccgcguggggaugggcgaggcggccgccaucuucaugacggccacgccgcccggguccgucgaggccuucccgcagagcaacgcggugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcugucccggaagacguucgacaccgaguaccagaagaccaagaacaacgacugggacuacguggucaccacggacaucagcgagaugggggccaacuuccgcgccgaccgggugaucgacccgcgccggugccucaagcccgucauccugaaggacggccccgagcgcgugauccuggcggggcccaugccggugaccgucgccuccgccgcccagcggcgcggccggaucggccgcaaccacaacaaggagggggaccaguacaucuacaugggccagccccucaacaacgacgaggaccacgcccacuggaccgaggcgaagaugcugcuggacaacaucaacacccccgaggggaucauccccgcccucuucgagccggagcgggagaaguccgccgccaucgacggcgaguaccgccugcgcggggaggcccggaagacguucguggagcugaugcgccggggcgaccuccccguguggcuguccuacaaggucgcgagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgccgccgggcgccggagcgucuccggcgaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacacgaucgagacccucaugcugcuggcgcucaucgccgugcugaccgggggcgucacccuguucuuccucuccgggcggggccugggcaagaccagcaucgggcugcucugcgugauggccuccagcgugcugcuguggauggccuccgucgagccccacuggaucgccgcgagcaucauccucgaguucuuccugauggugcugcucauccccgagccggaccgccagcggacgccccaggacaaccagcuggccuacguggucaucggccuccuguucaugauccugaccguggccgccaacgagauggggcugcucgagaccaccaagaaggaccugggcaucgggcacguggccgucgagaaccaccaccacgcgacgaugcuggacguggaccuccaccccgccuccgccuggacccuguacgccguggccaccaccaucaucacgccgaugaugcgccacaccaucgagaacaccaccgcgaacaucagccugacggccaucgccaaccaggccgccauccucaugggccuggacaagggcuggcccaucuccaagauggacaucggggucccccugcucgcgcugggcugcuacagccaggugaacccccugacccucaccgccgccgugcugaugcuggucgcccacuacgcgaucaucgggccgggccuccaggccaaggccacccgggaggcccagaagcgcacggccgcggggaucaugaagaaccccaccguggacggcaucguggccaucgaccuggaccccgucguguacgacgccaaguucgagaagcagcugggccagaucaugcuccugauccugugcaccucccagauccuccugaugcgcaccacgugggcccugugcgagagcaucacccucgccaccgggccccugaccacgcugugggagggcuccccggggaaguucuggaacaccaccaucgcggugagcauggccaacaucuuccggggcuccuaccucgccggcgccgggcuggccuucagccugaugaagucccucggcgggggccgccgggggaccggcgcgcagggcgagacgcugggggagaaguggaagcgccagcugaaccagcucuccaagagcgaguucaacaucuacaagcgguccggcaucauggaggucgaccgcagcgaggccaaggaggggcugaagcggggcgagaccacccgccacgccgugucccgggggaccgccaagcugcgcugguucguggagcggaaccuggucaagcccgagggcaaggugaucgaccucggcugcgggcgcggcggguggagcuacuacugcgcgggccugaagaaggugacggaggucaagggguacaccaagggcggccccgggcacgaggagcccaucccgauggccaccuacggcuggaaccuggugaagcuccacuccgggaaggacguguucuucacgccgcccgagaagugcgacacgcugcugugcgacaucggcgagagcucccccaacccgaccaucgaggaggggcggacccuccgcguccugaagaugguggagcccuggcugcggggcaaccaguucugcaucaagauccucaaccccuacaugcccagcguggucgagacccuggagcagaugcagcgcaagcacggcgggaugcuggugcggaacccgcucucccgcaacagcacccacgagauguacuggguguccugcggcacggggaacaucgucagcgccgugaacaugaccucccggaugcugcugaaccgcuucaccauggcccaccgcaagcccaccuacgagcgggacguggaccucggcgccggcacgcgccacgucgcgguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggugaacggcgucgugaagcugcucaccaagcccugggacgugauccccauggucacgcagaucgccaugaccgacaccacccccuucgggcagcagcgcguguucaaggagaagguggacacgcggaccccgaaggcgaagcgcggcaccgcccagaucauggaggucaccgcccgguggcuguggggcuuccugucccgcaacaagaagccccggaucugcacgcgcgaggaguucacccggaaggugcgcagcaacgccgccaucggggcgguguucgucgacgagaaccaguggaacuccgccaaggaggccguggaggacgagcgguucugggaccucgugcagaaggagcgcgagcugcacaagcagggcaagugcgcgaccugcgucuacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgccgacgacaccgcggggugggacacgcgcaucaccgaggacgaccugcagaacgaggccaagaucaccgacaucauggagccggagcacgcccugcucgccaccuccaucuucaagcugacguaccagaacaaggugguccgggugcagcgccccgccaagaacggcaccgugauggacgucaucagccgccgggaccagcgcggguccggccaggugggcaccuacgggcugaacaccuucacgaacauggaggcgcagcucauccggcagauggagagcgagggcaucuuccugcccuccgagcuggagacccccaaccucgccgagcgcgugcuggacuggcuggagaaguacggggucgagcggcucaagcgcauggccaucagcggcgacgacugcguggugaagccgaucgacgaccgguucgccaccgcccugaccgcgcugaacgacauggggaagguccgcaaggacaucccccagugggagcccuccaagggcuggaacgacuggcagcagguccccuucugcagccaccacuuccaccagcucaucaugaaggacggccgggagaucguggucccgugccgcaaccaggacgagcugguggggcgggcccgcgugucccagggcgccggguggagccugcgggagacggccugccucggcaagagcuacgcccagauguggcagcugauguacuuccaccgccgggaccugcgccucgcggccaacgccaucugcuccgccguccccguggacugggugcccaccagccggaccaccugguccauccacgcgcaccaccaguggaugacgaccgaggacaugcugagcgucuggaaccgcguguggaucgaggagaaccccuggauggaggacaagacccacguguccagcuggggcgacgucccguaccugggcaagcgggaggaccaguggugcggcucccucaucgggcugaccgcccgcgccaccugggccagcaacauccagguggccaucaaccaggugcgccggcugaucggcaacgagaacuaccucgacuacaugacguccaugaagcgcuucaagaacgagggggaccccgagggcgcgcugugguga

SEQ ID NO: 8677 - RNA, 9879 nt, Artificial Sequence
  derived and/or modified CDS sequence (opt1) from DENV-1__GU131777__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccaucuccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccacccccgggacguucaagacccccgagggcgaggugggcgccaucgcccuggacuucaagcccgggaccagcggcucccccaucgugaaccgcgaggggaagaucgucggccucuacggcaacgggguggugaccacgagcggcaccuacgucagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucgugcgggaggcgaucaagcgcaagcugcgcacgcucauccuggcccccacccgggucguggccuccgagauggccgaggcccugaagggcaugcccauccgcuaccagaccaccgcggucaagagcgagcacacgggcaaggagaucgucgaccucaugugccacgccaccuucaccaugcggcugcugucccccgugcgcgugccgaacuacaacaugaucaucauggacgaggcccacuucaccgaccccagcuccaucgccgcccggggguacaucagcacgcgcgucggcaugggggaggcggccgccaucuucaugaccgccacgccgcccggcuccguggaggccuucccgcagagcaacgcggugauccaggacgaggagcgggacauccccgagcgcuccuggaacagcggguacgaguggaucaccgacuuccccggcaagacggucugguucgugcccuccaucaagagcggcaacgacaucgccaacugccuccggaagaacgggaagcgcgugauccagcugucccggaagaccuucgacaccgaguaccagaagaccaagaacaacgacugggacuacgucgugacgaccgacaucagcgagaugggcgccaacuuccgcgccgaccgggugaucgacccgcgccggugccugaagcccgucauccucaaggacgggcccgagcgcgugauccuggcgggccccaugccggugaccgucgccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucguggagcugaugcgccgcggggaccugcccgucuggcucuccuacaagguggcgagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggugaugcuccacaacagcgagcagggcgggcgggccuaccgccacgccauggaggagcugcccgacaccaucgagacccugaugcuccuggcgcugaucgccguccucaccggcggggugacccuguucuuccuguccggccgggggcucggcaagacgagcaucggccugcugugcgugauggccuccagcguccuccuguggauggccuccguggagccccacuggaucgccgcgagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccacgaagaaggaccucgggaucggccacgucgccguggggaaccaccaccacgcggccaugcuggacguggaccugcaccccgccuccgccuggacccucuacgccgucgcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggugaacccccugacccugaccgccgccguccucaugcugguggcgcacuacgccaucaucgggccgggccugcaggccaaggccacccgcgaggcccagaagcggacggcggccgggaucaugaagaaccccaccguggacggcaucgucgccaucgaccucgaccccgugguguacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgucagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgugucccgcgggacggcgaagcugcggugguucgucgagcgcaaccuggugaagcccgagggcaaggugaucgaccugggcugcgggcggggcggguggagcuacuacugcgccggccucaagaaggucaccgaggugaagggguacaccaagggcggccccgggcacgaggagcccaucccgauggccaccuacggcuggaaccuggugaagcugcacuccgggaaggacgucuucuucaucccgcccgagaagugcgacacgcuccugugcgacaucggcgagagcucccccaacccgaccaucgaggaggggcgcacccugcgggugcucaagaugguggagcccuggcugcgcggcaaccaguucugcaucaagauccugaaccccuacaugcccagcgucguggagacccucgagcagaugcagcggaagcacggcgggaugcuggugcgcaacccgcugucccggaacagcacccacgagauguacugggucuccugcggcacggggaacaucgugagcgccgugaacaugaccucccgcaugcuccugaaccgcuucaccauggcccaccggaagcccaccuacgagcgcgacgucgaccugggcgcgggcacgcggcacguggccguggagcccgaggucgccaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggugaacggcgucgugaagcugcugaccaagcccugggacgucauccccauggugacgcagaucgcgaugaccgacaccacccccuucgggcagcagcggguguucaaggagaaggucgacacgcgcaccccgaaggccaagcggggcaccgcccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaaggucgugcgcgugcagcggcccgcgaagaacggcacggucauggacgugaucagccgccgggaccagcgcggguccggccaggugggcaccuacgggcugaacaccuucaccaacauggaggcccagcugauccggcagauggagagcgagggcaucuucucccccagcgagcucgagacgcccaaccuggccgagcgcguccuggacuggcucgagaaguacgggguggagcggcugaagcgcauggccaucuccggcgacgacugcguggucaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcccgcgucagccagggcgccggguggagccuccgggagaccgccugccugggcaaguccuacgcgcagauguggcagcugauguacuuccaccgccgggaccuccgccuggccgccaacgccaucugcagcgcggugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccucggcaagcgcgaggaccaguggugcggcagccugaucgggcugaccgcccgggccaccugggccaccaacauccaggucgcgaucaaccaggugcgccggcucaucggcaacgagaacuaccuggacuacaugacguccaugaagcgcuucaagaacgagagcgaccccgagggggcccugugguga

SEQ ID NO: 8678 - RNA, 9879 nt, Artificial Sequence
  derived and/or modified CDS sequence (opt1) from DENV-1__GU131778__SS-prME
agcgugaccaugcugcucaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggggaguucugcgaggacaccaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggccccgcagccacacgcugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcaccacgguggucguggacgagcacugcggcaaccgcgggccgagccugcggaccaccaccgugacgggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacccucgccguguucuuccugcugaucauggggcagcucacguggaacgaccugauccgccugugcaucauggucggcgcgaacgccuccgaccgcauggggaugggcaccaccuaccucgcccugauggccaccuucaagaugcggccgauguucgccgugggccuccuguuccgccggcugacgagccgcgaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgcgacgacacccugaccauccugcucaaggccacccugcuggccgugagcggcguguacccgcucuccauccccgccacgcuguucgucugguacuucuggcagaagaagaagcagcggagcggggugcugugggacauccccagcccgcccgagguggagcgcgccguccucgacgacggcaucuaccggaucaugcagcgcggccugcuggggcggagccaggugggcgugggggucuuccaggagaacguguuccacaccauguggcacgugacccgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgggaggggaagaucgugggccuguacggcaacggggucgugacgaccuccggcaccuacgugagcgccaucgcccaggccaaggcgucccaggaggggccccugccggagaucgaggacgaggucuuccgcaagcggaaccucaccaucauggaccugcaccccggcagcgggaagacgcgccgguaccugcccgccaucgugcgcgaggccaucaagcggaagcuccgcacccugauccuggccccgacccgcguggucgccuccgagauggcggaggcccucaagggcaugcccauccgguaccagaccacggccgucaagagcgagcacaccggcaaggagaucguggaccugaugugccacgccaccuucaccaugcgccugcucucccccguccgggugcccaacuacaacaugaucaucauggacgaggcccacuucacggacccgagcuccaucgcggcccgcggguacaucagcacccgggugggcaugggggaggccgccgccaucuucaugaccgcgacgccgcccggcuccgucgaggccuucccccagagcaacgccgugauccaggacgaggagcgcgacaucccggagcgguccuggaacagcggguacgaguggaucacggacuuccccggcaagaccgugugguucguccccuccaucaagagcggcaacgacaucgccaacugccugcgcaagaacgggaagcgggugauccagcugucccgcaagaccuucgacaccgaguaccagaagacgaagaacaacgacugggacuacguggucaccaccgacaucagcgagaugggcgcgaacuuccgggccgaccgcgugaucgacccccggcgcugccucaagccggugauccugaaggacgggcccgagcgggucauccuggccggccccaugcccgugaccgucgccuccgccgcgcagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccgccugcggggcgaggcccgcaagaccuucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggacguacuccgacccccuggcccuccgcgaguucaaggaguucgcggccggccggcgcagcgucuccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacccucaugcugcuggcccucaucgccgugcugacgggcggggucacccuguucuuccucuccggccgcgggcugggcaagaccagcaucggccugcucugcgugauggccuccagcgugcugcuguggauggcguccgucgagccccacuggaucgccgccagcaucauccucgaguucuuccugauggugcugcucauccccgagcccgaccggcagcgcaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcggcacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgcgaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcggacgaccugggcccugugcgagagcaucacccucgccaccggcccccugacgacccugugggaggggucccccggcaaguucuggaacaccaccaucgccgugagcauggccaacaucuuccgcgggagcuaccucgcgggcgccggccuggccuucucccugaugaagucccucgggggcgggcggcgcggcacgggggcccagggcgagacccugggcgagaaguggaagcggcagcugaaccagcucuccaagagcgaguucaacaccuacaagcgcuccgggaucauggaggucgaccggagcgaggcgaaggagggccugaagcgcggggagaccacgaagcacgccgugucccggggcaccgccaagcugcgcugguucguggagcggaaccucgucaagccggaggggaaggugaucgaccugggcugcggccgcgggggcuggagcuacuacugcgccgggcugaagaaggugaccgaggucaagggcuacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccggacccuccgcguccugaagaugguggagccguggcugcgggggaaccaguucugcaucaagauccucaaccccuacaugcccagcguggucgagacgcuggagcagaugcagcgcaagcacggcggcaugcuggugcggaacccccucucccgcaacagcacccacgagauguacuggguguccugcgggaccggcaacaucgucagcgcggugaacaugaccucccggaugcugcugaaccgcuucaccauggcccaccgcaagccgacguacgagcgggacguggaccucggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcgcguguucaaggagaagguggacacccggacccccaaggccaagcgcgggaccgcccagaucauggaggucacggcgaaguggcuguggggcuuccugucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagccgcauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcgcccggccaagaacgggaccgugauggacgucaucagccggcgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucaccgcccgcgcgacgugggccaccaacauccaggucgccaucaaccaggugcggcgccugaucggcaacgagaacuaccuggacuacaugaccuccaugaagcgguucaagaacgagagcgacccggagggggcccucugguga

SEQ ID NO: 8679 - RNA, 9879 nt, Artificial Sequence
  derived and/or modified CDS sequence (opt1) from DENV-1__GU131779__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggucuccguggagcuccccaacagccuggaggagcugggcgacgggcucgccaugggcaucaugauccugaagcugcucaccgacuuccagucccaccagcugugggcgacgcugcucagccugaccuucaucaagaccaccuucucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgccgagaacaagaucuggggccggcgcuccuggccccugaacgaggggaucauggcggucggcaucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggaccaugaagaucaaggacgaggagcgggacgacacccucaccauccugcugaaggccacgcuccuggcgguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacgcggggcgccguccugauguaccaggggaagcgccuggagcccagcugggccuccgugaagaaggaccucaucagcuacggcggcggguggcggcugcagggcuccuggaacaccggggaggaggugcaggucaucgcgguggagcccggcaagaaccccaagaacgugcagaccacccccgggacguucaagacccccgagggcgaggucggcgccaucgcccuggacuucaagcccgggaccagcggcucccccaucgugaaccgcgaggggaagaucgugggccucuacggcaacggggucgugaccacgagcggcaccuacgugagcgccaucgcccaggcgaaggccucccaggaggggccgcugcccgagaucgaggacgaggucuuccggaagcgcaaccugaccaucauggaccuccaccccggcagcgggaagacccggcgcuaccugccggccaucgugcgggaggccaucaagcgcaagcugcgcacgcucauccuggcgcccacccggguggucgccuccgagauggccgaggcccugaagggcaugcccauccgcuaccagaccaccgccgucaagagcgagcacacgggcaaggagaucguggaccucaugugccacgcgaccuucaccaugcggcugcugucccccguccgcgugccgaacuacaacaugaucaucauggacgaggcccacuucaccgaccccagcuccaucgccgcccggggguacaucagcacgcgcgugggcaugggggaggccgcggccaucuucaugaccgccacgccgcccggcuccgucgaggccuucccgcagagcaacgccgugauccaggacgaggagcgggacauccccgagcgcuccuggaacagcggguacgaguggaucaccgacuuccccggcaagacggugugguucguccccuccaucaagagcggcaacgacaucgcgaacugccuccggaagaacgggaagcgcgugauccagcugucccggaagaccuucgacaccgaguaccagaagaccaagaacaacgacugggacuacguggucacgaccgacaucagcgagaugggcgccaacuuccgcgccgaccgggugaucgacccgcgccggugccugaagcccgugauccucaaggacgggcccgagcgcgucauccuggccggccccaugccggugaccgucgcguccgccgcccagcggcgcgggcggaucggccgcaaccacaacaaggagggcgaccaguacaucuacauggggcagccccugaacaacgacgaggaccacgcccacuggaccgaggccaagaugcuccuggacaacaucaacacgcccgagggcaucauccccgcgcuguucgagccggagcgcgagaaguccgccgccaucgacggggaguaccggcuccgcggcgaggcccggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcgcgcaccuacuccgacccccuggcccugcgggaguucaaggaguucgccgccggccgccggagcgucuccggggaccucauccuggagaucggcaagcugccgcagcaccucacgcagcgcgcccagaacgcgcuggacaaccuggugaugcuccacaacagcgagcagggcgggcgggccuaccgccacgccauggaggagcugcccgacaccaucgagacccugaugcuccuggcccugaucgcggugcucaccggcggggucacccuguucuuccuguccggccgggggcucggcaagacgagcaucggccugcugugcgugauggccuccagcgugcuccuguggauggccuccgucgagccccacuggaucgccgccagcaucauccuggaguucuuccucauggugcugcugauccccgagccggaccgccagcggacgccccaggacaaccagcucgcguacguggucaucgggcugcuguucaugauccucaccguggccgccaacgagaugggccugcuggagaccacgaagaaggaccucgggaucggccacguggccgucgggaaccaccaccacgccgcgaugcuggacguggaccugcaccccgccuccgccuggacccucuacgccguggccaccaccaucaucacgccgaugaugcgccacaccaucgagaacaccaccgcgaacaucagccugacggccaucgccaaccaggccgccauccugaugggccucgacaagggcuggcccaucuccaagauggacaucggggucccccugcuggcgcucggcugcuacagccaggugaacccccugacccugaccgccgccgugcucaugcuggucgcccacuacgcgaucaucgggccgggccugcaggccaaggccacccgcgaggcccagaagcggacggccgcggggaucaugaagaaccccaccguggacggcaucguggccaucgaccucgaccccgucguguacgacgccaaguucgagaagcagcugggccagaucaugcugcucauccugugcaccucccagauccugcucaugcgcaccacgugggcccugugcgagagcaucacccuggccaccgggccccucaccacgcugugggagggcuccccggggaaguucuggaacaccaccaucgcggugagcauggccaacaucuuccggggcuccuaccuggccggcgccgggcucgccuucagccugaugaagucccugggcgggggccgccgggggaccggcgcgcagggcgagacgcucggggagaaguggaagcgccagcugaaccagcuguccaagagcgaguucaacaccuacaagcgguccggcaucauggaggucgaccgcagcgaggccaaggaggggcucaagcggggcgagaccaccaagcacgccgugucccgcgggacggccaagcugcggugguucguggagcgcaaccuggucaagcccgagggcaaggugaucgaccugggcugcgggcggggcggguggagcuacuacugcgcgggccucaagaaggugaccgaggucaagggguacaccaagggcggccccgggcacgaggagcccaucccgauggccaccuacggcuggaaccuggugaagcugcacuccgggaaggacguguucuucaucccgcccgagaagugcgacacgcuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcacggggaacaucgucagcgccgugaacaugaccucccgcaugcuccugaaccgcuucaccauggcccaccggaagcccaccuacgagcgcgacguggaccugggcgccggcacgcggcacgucgcgguggagcccgagguggccaaccucgacaucaucgggcagcgcaucgagaacaucaagcacgagcacaagagcaccuggcacuacgacgaggacaaccccuacaagaccugggccuaccacggcuccuacgaggucaagccgagcggguccgccagcagcauggugaacggcgucgugaagcugcugaccaagcccugggacgugauccccauggucacgcagaucgccaugaccgacaccacccccuucgggcagcagcggguguucaaggagaagguggacacgcgcaccccgaaggcgaagcggggcaccgcccagaucauggaggucaccgccaaguggcucuggggcuuccugucccgcaacaagaagccccggaucugcacgcgcgaggaguucacccggaaggugcgcagcaacgccgccaucggggcgguguucgucgacgagaaccaguggaacuccgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgccgacgacaccgcggggugggacacgcggaucaccgaggacgaccuccagaacgaggcccgcaucaccgacaucauggagccggagcacgcccugcuggccaaguccaucuucaagcucaccuaccagaacaaggugguccgcgugcagcggcccgccaagaacggcacggugauggacgucaucagccgccgggaccagcgcggguccggccaggugggcaccuacgggcugaacaccuucaccaacauggaggcgcagcugauccggcagauggagagcgagggcaucuucucccccagcgagcucgagacgcccaaccuggccgagcgcgugcuggacuggcucgagaaguacggggucgagcggcugaagcgcauggccaucuccggcgacgacugcguggugaagccgaucgacgaccgguucgccaccgcccugaccgcgcucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgccggguggagccuccgggagaccgccugccugggcaaguccuacgcccagauguggcagcugauguacuuccaccgccgggaccuccgccuggcggccaacgccaucugcagcgccguccccguggacuggauccccacgucccggaccaccuggagcauccacgcgcaccaccaguggaugaccacggaggacaugcuguccguguggaaccgcgucuggaucgaggagaaccccuggauggaggacaagacccacaucagcuccuggggcgacgugccguaccucggcaagcgcgaggaccaguggugcggcagccugaucgggcugaccgcccgggccaccugggccaccaacauccagguggccaucaaccagguccgccggcucaucggcaacgagaacuaccuggacuacaugacguccaugaagcgcuucaagaacgagagcgaccccgagggggcgcugugguga

SEQ ID NO: 8680 - RNA, 9879 nt, Artificial Sequence
  derived and/or modified CDS sequence (opt1) from DENV-1__GU131780__SS-prME
agcgugaccaugcugcucaugcugaugcccaccgcccuggccuuccaccucacgacccggggcggggagccccacaugaucgugagcaagcaggagcggggcaagagccugcuguucaagaccuccgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucuccgggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcugagcugguucaagaagggguccagcaucggcaagauguucgaggccaccgcccgcggggcccggcgcauggccauccucggcgacacggcgugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccucuccgcggccaucggcaaggccugggaggagggggucugcggcauccggagcgccacccgccuggagaacaucauguggaagcagaucuccaacgagcugaaccacauccuccuggagaacgacaugaaguucaccgugguggucggggacguggccggcauccuggcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacgguggucguggacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucacguggaacgaccugauccggcugugcaucauggucggcgccaacgcgagcgaccgcauggggaugggcaccaccuaccucgcccugauggccaccuucaagaugcgcccgauguucgccgugggccuccuguuccggcgccugacgucccgggaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaagagcuggccccugaacgaggggaucauggccgucggcaucguguccauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacccugcugacgguguccggcguguacccgcucagcauccccgccacccuguucgucugguacuucuggcagaagaagaagcagcgcuccggggugcugugggacacccccagcccgcccaagguggagcgggccguccucgacgacggcaucuaccgcaucaugcagcggggccugcuggggcgcucccaggugggcgugggggucuuccaggagaacguguuccacaccauguggcacgugacgcggggcgccguccugauguaccaggggaagcgccucgagcccagcugggccuccgugaagaaggaccugaucagcuacggcggcggguggcggcugcagggcuccuggaacaccggggaggaggugcaggucaucgcgguggagcccggcaagaaccccaagaacgugcagaccgcccccgggaccuucaagacgagcgagggcgaggucggcgccaucgcccucgacuucaagcccgggaccagcggcucccccaucgugaaccgcgaggggaagaucgugggccuguacggcaacggggucgugaccaccagcggcacguacguguccgccaucgcgcaggccaaggccagccaggaggggccccugccggagaucgaggacgaggucuuccggaagcgcaaccucaccaucauggaccugcaccccggcuccgggaagacccggcgcuaccugcccgccaucgugcgggaggcgaucaagcgcaagcuccggacccugauccuggccccgacgcgcguggucgccagcgagauggccgaggcccucaagggcaugcccauccgcuaccagaccaccgcggugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgccgcccggggguacaucuccacccgcgugggcaugggggaggcggccgccaucuucaugacggccacgccgcccggcagcgucgaggccuucccccaguccaacgcggugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccccgccggugccucaagccggugauccugaaggacgggcccgagcgcgucauccuggcgggccccaugcccgugaccgucgccagcgccgcccagcggcgcgggcggaucggccgcaaccacaacaaggagggcgaccaguacaucuacauggggcagccgcucaacaacgacgaggaccacgcccacuggaccgaggcgaagaugcugcuggacaacaucaacacccccgagggcaucauccccgcccucuucgagcccgagcgggagaaguccgccgccaucgacggggaguaccgccugcgcggcgaggcccggaagacguucguggagcugaugcgccgcggggaccucccgguguggcuguccuacaaggucgcgagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgccgccggccgccgguccgucagcggggaccugauccuggagaucggcaagcucccccagcaccugacccagcgcgcgcagaacgcccuggacaaccucgugaugcugcacaacuccgagcagggcgggcgggccuaccgccacgccauggaggagcugccggacacgaucgagaccaugaugcuccuggcgcugaucgccgugcucaccggcggggucacccuguucuuccugagcggccgggggcucggcaagaccuccaucggccugcugugcgugauggccagcuccgugcuccuguggauggccagcgucgagccccacuggaucgccgcguccaucauccuggaguucuuccucauggugcugcugauccccgagcccgaccgccagcggacgccgcaggacaaccagcucgccuacguggucaucgggcugcuguucaugauccucaccguggccgccaacgagaugggccugcuggagaccaccaagaaggaccucgggaucggccacguggccgucgagaaccaccaccacgcggccaugcuggacguggaccugcaccccgccagcgccuggacgcucuacgccguggcgaccaccaucaucacccccaugaugcgccacacgaucgagaacaccaccgccaacaucucccugaccgccaucgccaaccaggccgcgauccugauggggcucgacaagggcuggccgaucagcaagauggacaucggcgucccccugcuggcccucgggugcuacucccaggugaacccccugacgcugaccgccgccgugcucaugcuggucgcgcacuacgccaucaucggccccgggcugcaggccaaggccacccgggaggcccagaagcgcaccgcggccggcaucaugaagaacccgacgguggacgggaucguggccaucgaccucgaccccgucguguacgacgccaaguucgagaagcagcugggccagaucaugcugcucauccugugcaccagccagauccugcucaugcgcaccaccugggcccugugcgaguccaucacgcuggcgaccggcccccucaccacccugugggaggggagccccggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgccgugagccgcggcaccgcgaagcugcggugguucguggagcgcaaccuggucaagccggaggggaaggugaucgaccucggcugcggccgcggcgggugguccuacuacugcgccgggcugaagaaggugacggaggucaagggguacaccaagggcgggcccggccacgaggagcccauccccauggccaccuacggguggaaccuggugaagcugcacagcggcaaggacguguucuucaucccgcccgagaagugcgacacccuccugugcgacaucggggaguccagccccaaccccacgaucgaggagggccgcacccugcggguccucaagaugguggagccguggcugcgcgggaaccaguucugcaucaagauccugaaccccuacaugcccuccguggucgagacccucgagcagaugcagcggaagcacggcggcaugcuggugcgcaacccccugagccggaacuccacccacgagauguacugggugagcugcgggaccggcaacaucgucuccgccgugaacaugacgagccgcaugcuccugaaccgguucaccauggcccaccgcaagccgaccuacgagcgcgacguggaccugggggcgggcacccggcacgucgccguggagcccgagguggccaaccucgacaucaucggccagcgcaucgagaacaucaagcacgagcacaaguccacguggcacuacgacgaggacaaccccuacaagaccugggccuaccacgggagcuacgaggucaagcccagcggcuccgccagcuccauggugaacggggucgugaagcugcugaccaagccgugggacgugauccccauggucacccagaucgcgaugacggacaccacccccuucggccagcagcggguguucaaggagaagguggacacccgcacgcccaaggccaagcgggggaccgcccagaucauggaggucaccgccaaguggcucuggggcuuccugagccgcaacaagaagccgcggaucugcacccgcgaggaguucacgcggaaggugcgcuccaacgccgcgaucggcgccguguucgucgacgagaaccaguggaacagcgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggucccgggccaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgcggacgacaccgccggcugggacacccggaucacggaggacgaccuccagaacgaggccaagaucaccgacaucauggagcccgagcacgcccugcuggccaagagcaucuucaagcucaccuaccagaacaaggugguccgcgugcagcggccggcgaagaacgggaccgugauggacgucaucucccgccgcgaccagcggggcagcggccaggugggcacguacggccugaacaccuucaccaacauggaggcccagcugauccgccagauggaguccgaggggaucuucagccccuccgagcucgagacccccaaccuggcccggcgcgugcuggacuggcucgagaagcacggcgucgagcggcugaagcgcauggccaucagcggggacgacugcguggugaagcccaucgacgaccgguucgccacggcgcugaccgcccucaacgacaugggcaagguccgcaaggacaucccgcagugggagcccagcaagggguggaacgacuggcagcagguccccuucugcucccaccacuuccaccagcugaucaugaaggacggccgggagaucgugguccccugccgcaaccaggacgagcuggugggccgggcccgcgugagccagggggccggcuggucccuccgggagaccgccugccugggcaagagcuacgcgcagauguggcagcugauguacuuccaccgccgggaccuccgccuggccgccaacgccaucugcuccgcggucccgguggacugggugcccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugcccuaccucgggaagcgggaggaccaguggugcggcucccugaucggccugaccgcccgcgccaccugggccaccaacauccaggucgcgaucaaccaggugcgccggcucaucgggaacgagaacuaccuggacuacaugaccagcaugaagcgcuucaagaacgaguccgacccggagggcgcccugugguga

SEQ ID NO: 8681 - RNA, 9879 nt, Artificial Sequence
  derived and/or modified CDS sequence (opt1) from DENV-1__GU131781__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggacaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucgugaacuggaagggccgggagcugaagugcgggagcggcaucuucgugaccaacgagguccacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccuguuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgugagccuguucccccucugcauguccaccacgagccagaagaccaccuggcugcccguccugcucggcucccuggggugcaagccgcugaccauguuccucaucgccgagaacaagaucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgcuguccauccccgccacccucuucgugugguacuucuggcagaagaagaagcagcgcagcggggugcugugggacacgcccagcccgcccgaggucgagcgggccgugcuggacgacggcaucuaccgcaucaugcagcggggccuccuggggcgcagccaggugggcgucgggguguuccaggagaacguguuccacaccauguggcacgucacccggggcgcggugcugauguaccaggggaagcgccuggagcccuccugggccagcgugaagaaggaccucaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgcgaggggaagaucgucggccucuacggcaacgggguggugacgaccuccggcaccuacgucagcgccaucgcccaggccaaggcgucccaggaggggccccugccggagaucgaggacgagguguuccggaagcgcaaccugaccaucauggaccuccaccccggcagcgggaagacgcggcgcuaccugcccgccaucgugcgggaggccaucaagcgcaagcugcggacccucauccuggccccgacccgcgucguggccuccgagauggcggaggcccugaagggcaugcccauccgcuaccagaccacggccgucaagagcgagcacaccggcaaggagaucgucgaccucaugugccacgccaccuucaccaugcggcugcugucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccuccggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccugaagccggucauccucaaggacgggcccgagcgcgugauccuggccggccccaugcccgucaccguggccuccgccgcgcagcggcgcgggcggaucggccgcaaccacaacaaggagggcgaccaguacguguacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucgucgagcugaugcgccgcggggaccugccgguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccccagcaccucacccagcgcgcccagaacgcccuggacaaccuggucaugcuccacaacagcgagcagggcgggcgggcguaccgccacgccauggaggagcugccggacaccaucgagacccugaugcuccuggcccugaucgccgugcucacgggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagcccgaccgccagcggaccccgcaggacaaccagcucgccuacguggugaucgggcugcuguucaugauccucaccgucgccgcgaacgagaugggccugcuggagacgaccaagaaggaccucgggaucggccacguggccguggagaaccaccaccacgccgccaugcuggacgucgaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgugccccugcuggcccucgggugcuacagccaggucaacccccugacccugaccgcggccgugcucaugcugguggcccacuacgccaucaucggccccgggcugcaggccaaggcgacgcgggaggcccagaagcgcaccgccgccggcaucaugaagaacccgaccgucgacgggaucguggccaucgaccucgaccccguggucuacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagaccacgaagcacgccgucucccgcggcaccgccaagcugcggugguucguggagcgcaaccuggugaagccggaggggaaggucaucgaccucggcugcggccgcggcggguggagcuacuacugcgccgggcugaagaaggugaccgaggugaagggguacaccaagggcggccccggccacgaggagcccauccccauggccacguacggguggaaccuggucaagcugcacuccggcaaggacguguucuucaucccgcccgagaagugcgacacccuccugugcgacaucggggagagcucccccaaccccaccaucgaggagggccgcacccugcgggugcucaagauggucgagccguggcugcgcgggaaccaguucugcaucaagauccugaaccccuacaugcccagcgugguggagacgcucgagcagaugcagcggaagcacggcggcaugcugguccgcaacccccugucccggaacagcacccacgagauguacuggguguccugcgggaccggcaacaucgugagcgcggucaacaugaccucccgcaugcuccugaaccgguucaccauggcccaccgcaagccgacguacgagcgcgacguggaccugggggccggcacccggcacguggccgucgagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacgggguggucaagcugcugacgaagccgugggacgugauccccauggugacccagaucgccaugaccgacaccacgcccuucggccagcagcgggucuucaaggagaagguggacacccgcacccccaaggccaagcgggggaccgcccagaucauggaggugacggcgaaguggcucuggggcuuccugucccgcaacaagaagccgcggaucugcacccgcgaggaguucacccggaagguccgcagcaacgccgccaucggcgccguguucguggacgagaaccaguggaacuccgcgaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggcccgcuccaucuucaagcucacguaccagaacaagguggugcggguccagcgcccggccaagaacgggaccgugauggacgugaucagccgccgggaccagcgcggcuccgggcaggucggcaccuacggccugaacaccuucacgaacauggaggcccagcugauccggcagauggagagcgaggggaucuucucccccagcgagcucgagacccccaaccuggccggccgcgugcuggacuggcucgagaagcacgggguggagcggcugaagcgcauggcgaucuccggcgacgacugcgucgugaagcccaucgacgaccgguucgccaccgcccugaccgcccucaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcuggucgggcgggcccgcgugucccagggcgcgggguggagccuccgggagacggccugccugggcaaguccuacgcccagauguggcagcugauguacuuccaccgccgggaccuccgccuggccgcgaacgccaucugcagcgccgugccggucgacugggugcccaccucccggaccaccuggagcauccacgcccaccaccaguggaugacgaccgaggacaugcuguccguguggaaccgcgucuggaucgaggagaaccccuggauggaggacaagacccacaucagcuccuggggcgacgugcccuaccucggcaagcgggaggaccaguggugcggcagccugaucgggcugaccgcccgcgcgacgugggccaccaacauccagguggccaucaaccagguccgccggcucaucggcaacgagaacuaccuggacuacaugaccuccaugaagcgcuucaagaacgagagcgacccggagggggcccugugguga

SEQ ID NO: 8682 - RNA, 9879 nt, Artificial Sequence
  derived and/or modified CDS sequence (opt1) from DENV-1__GU131782__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugcccgacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggccucggcgaggucgacagcuucucccuggggcugcucugcaucagcaucaugaucgaggaggugaugcgcucccgguggagccgcaagaugcugauggccggcacccuggccguguuccuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagccccaccagcugugggccacccuccugagccugaccuucaucaagacgacccucucccugcacuacgccuggaagaccauggcgaugguccugagcaucgugucccucuucccccugugccugagcaccacgucccagaagaccaccuggcucccggugcugcugggcagccucgggugcaagccccugaccauguuccugaucgccgagaacaagaucuggggccgcaaguccuggccccucaacgaggggaucauggccgucggcguggugagcauccugcuguccagccuccugaagaacgacgucccccuggccgggccgcucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggacgaugaagaucaaggacgaggagcgggacgacacccugaccauccuccugaaggccacccugcucgccaucuccggcguguacccccugagcauccccgccacccuguucgucugguacuucuggcagaagaagaagcagcgcuccggggugcugugggacacgcccagcccgcccgagguggagcgggccguccucgacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacaccggggaggaggugcaggucaucgccguggagcccggcaagaacccgaagaacgugcagacggcccccgggaccuucaagacccccgagggcgaggucggcgccaucgcgcuggacuucaagcccgggaccagcggcuccccgaucgugaaccgcgaggggaagaucgugggccuguacggcaacggggucgugacgaccagcggcaccuacguguccgccaucgcccaggccaaggcgagccaggaggggccccuccccgagaucgaggacgaggucuuccggaagcgcaaccugaccaucauggaccugcacccgggcagcgggaagacgcggcgcuaccuccccgccaucgugcgggaggccaucaagcgcaagcugcggacccugauccucgcccccacccgcguggucgccuccgagauggcggaggcccugaagggcaugcccauccgcuaccagaccacggccgucaagagcgagcacaccggcaaggagaucguggaccugaugugccacgccaccuucaccaugcggcuccuguccccgguccgcgugcccaacuacaacaugaucaucauggacgaggcccacuucacggaccccagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacauccccgagcgcuccuggaacagcggguacgaguggaucacggacuuccccggcaagaccgugugguucguccccuccaucaagagcggcaacgacaucgccaacugccugcggaagaacgggaagcgcgugauccagcucucccggaagaccuucgacaccgaguaccagaagacgaagaacaacgacugggacuacguggucaccaccgacaucagcgagaugggcgcgaacuuccgcgccgaccgggugaucgacccccgccggugccugaagcccgugauccugaaggacgggcccgagcgcgucauccucgccggcccgaugcccgugaccgucgccuccgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucaucccggcccuguucgagcccgagcgggagaaguccgccgcgaucgacggggaguaccgccugcgcggcgaggcccggaagaccuucguggagcucaugcgccgcggggaccugcccguguggcuguccuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccgcucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcuccccgacaccaucgagacccugaugcugcucgcccugaucgccgugcugacgggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugaucccggagcccgaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccaccaugcucgacguggaccugcacccggccuccgccuggacccuguacgcgguggccacgaccaucaucacccccaugaugcgccacaccaucgagaacacgaccgccaacaucagccucaccgccaucgccaaccaggcggccauccugauggggcuggacaagggcuggcccaucuccaagauggacaucggcgucccccuccuggcccuggggugcuacagccaggugaacccgcucacccugacggccgcggugcugaugcucgucgcccacuacgccaucaucggccccgggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgucccagauccugcugaugcgcaccaccugggcgcucugcgagagcaucacccuggccacgggcccgcugaccacccucugggaggggucccccggcaaguucuggaacaccacgaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcugagcaagagcgaguucaacaucuacaagcgguccgggaucauggaggucgaccgcagcgaggccaaggagggccugaagcgcggggagaccacgcgccacgcggugucccggggcaccgccaagcugcgcugguucguggagcggaaccucgucaagcccgaggggaaggugaucgaccugggcugcggccgcgggggcuggagcuacuacugcgccgggcugaagaaggugaccgaggucaagggcuacaccaagggcgggcccggccacgaggagccgauccccauggccacguacggguggaaccucgugaagcugcacuccggcaaggacguguucuucacgccgcccgagcggugcgacacccugcucugcgacaucggggagagcuccccgaaccccaccaucgaggagggccgcacgcugcggguccugaagaugguggagcccuggcuccgcgggaaccaguucugcaucaagauccugaaccccuacaugccgagcguggucgagacccuggagcagaugcagcggaagcacggcggcaugcucgugcgcaacccccugucccggaacagcacccacgagauguacuggguguccugcgggaccggcaacaucgucagcgccgugaacaugaccucccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaacccguacaagacgugggccuaccacggguccuacgaggucaagcccagcggcuccgcgagcuccauggugaacggggucgugaagcuccugaccaagcccugggacgugauccccauggucacccagaucgccaugaccgacacgaccccguucggccagcagcggguguucaaggagaagguggacacccgcacccccaaggccaagcgggggacggcccagaucauggaggucaccgcccgcuggcuguggggcuuccucagccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcagaaggagcgggagcugcacaagcaggggaagugcgccacgugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcccuccuggcgaccuccaucuucaagcugaccuaccagaacaaggugguccgcgugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuuccugcccuccgagcucgagaccccgaaccuggccgagcgggugcuggacuggcucgagaagcacggcgucgagcgccugaagcggauggccaucagcggggacgacugcguggugaagcccaucgacgaccgcuucgcgacggcccugaccgcccucaacgacaugggcaagguccggaaggacaucccccagugggagcccuccaagggguggaacgacuggcagcaggucccguucugcagccaccacuuccaccagcugaucaugaaggacggccgcgagaucgugguccccugccggaaccaggacgagcuggugggccgcgcccgggugucccagggggccggcuggagccuccgcgagaccgcgugccuggggaaguccuacgcccagauguggcagcugauguacuuccaccggcgcgaccuccggcuggccgccaacgcgaucugcagcgccguccccguggacugggugcccaccagccgcacgaccugguccauccacgcccaccaccaguggaugaccaccgaggacaugcugagcgucuggaaccggguguggaucgaggagaacccguggauggaggacaagacgcacguguccagcuggggcgacguccccuaccucgggaagcgcgaggaccaguggugcggcucccugaucggccugaccgcccgcgccaccugggcgagcaacauccagguggccaucaaccaggugcggcgccucaucgggaacgagaacuaccuggacuacaugaccuccaugaagcgguucaagaacgagggcgaccccgagggggcccugugguga

SEQ ID NO: 8683 - RNA, 9879 nt, Artificial Sequence
  derived and/or modified CDS sequence (opt1) from DENV-1__GU131784__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccaccacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacgccgccguggagaaccaccaccacgccgccaugcuggacgucgaccuccaccccgcguccgccuggacccuguacgccguggccacgaccaucaucacccccaugaugcgccacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggcgaacaucuuccgggggagcuaccucgccggcgccggccuggccuucucccugaugaagucccucgggggcgggcgccggggcaccggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcggccccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucacgauggcccaccgcaagccgaccuacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcgcagaucauggaggugaccgccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggcgcggcgcgugcucgacuggcuggagaagcacggcguggagcggcugaagcgcauggccaucuccggggacgacugcgucgugaagcccaucgacgaccgguucgccaccgcccucacggcccugaacgacaugggcaaggugcgcaaggacaucccgcagugggagcccagcaagggguggaacgacuggcagcagguccccuucugcagccaccacuuccaccagcugaucaugaaggacggccgggagaucguggugcccugccgcaaccaggacgagcucgucggccgggcgcgcgugucccagggggccggcuggagccugcgggagaccgccugccuggggaaguccuacgcccagauguggcagcucauguacuuccaccgccgggaccugcgccuggcggccaacgccaucugcagcgccgugccggucgacugggugcccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugcccuaccuggggaagcgggaggaccaguggugcggcagccugaucggccucacggcgcgcgccaccugggccaccaacauccagguggccaucaaccagguccgccggcugaucgggaacgagaacuaccuggacuacaugaccuccaugaagcgcuucaagaacgagagcgacccggagggcgcccucugguga

SEQ ID NO: 8684 - RNA, 9879 nt, Artificial Sequence
  derived and/or modified CDS sequence (opt1) from DENV-1__JF937612__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacgccaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccauccgggacagcaaggccgugcacgccgacaugggcuacuggaucgaguccgagaagaacgagaccuggaagcuggcgcgcgccagcuucaucgaggucaagaccugcaucuggcccaagucccacacgcuguggagcaacggcgugcucgaguccgagaugaucauccccaagaucuacgggggcccgaucagccagcacaacuaccggcccggguacuucacccaggccgccggccccuggcaccuggggaagcuggagcucgacuucgaccugugcgagggcaccaccguggucguggacgagcacugcggcaaccgcgggccgucccugcggacgaccaccgugaccggcaagaucauccacgaguggugcugccgcagcugcacgcugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgccgcaugcucaugaccggcacccuggcgguguucuuccugcucaucauggggcagcugaccuggaacgaccugauccggcucugcaucauggucggcgccaacgccagcgaccgcauggggaugggcacgaccuaccuggcccugauggccaccuucaagaugcggccgauguucgcggugggccuccuguuccgccggcugaccucccgcgaggugcuccugcugacgaucgggcucagccuggucgccuccguggagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccaugguccugagcaucgugucccucuucccccugugccugagcaccacgucccagaagaccaccuggcuccccgugcugcugggcagccucgggugcaagccgcugaccauguuccugaucgccgagaacaagaucuggggccggcgcuccuggccccucaacgaggggaucauggccgucggcaucgugagcauccugcugagcucccuccugaagaacgacgugccccuggccgggccccucaucgcgggcggcaugcugaucgccugcuacgucaucagcggguccagcgccgaccugucccucgagaaggccgccgaggugagcugggaggaggaggcggagcacuccggcgccagccacaacauccugguggagguccaggacgacgggacgaugaagaucaaggacgaggagcgggacgacacccugaccauccuccugaaggccacccugcucgccguguccggcguguacccgcugagcauccccgccacccuguucgucugguacuucuggcagaagaagaagcagcgcuccggggugcucugggacacgcccagcccgcccgagguggagcgggcgguccuggacgacggcaucuaccgcaucaugcagcggggccugcuggggcgcucccaggugggcgugggggucuuccaggagaacguguuccacaccauguggcacgugacccggggcgccguccucauguaccaggggaagcgccuggagcccagcugggccuccgugaagaaggaccugaucagcuacggcggcggguggcggcuccagggcuccuggaacaccggggaggaggugcaggucaucgccguggagcccggcaagaaccccaagaacgugcagacggcccccgggaccuucaagacccccgagggcgaggucggcgcgaucgcccuggacuucaagcccgggaccagcggcucccccaucgugaaccgcgaggggaagaucgugggccuguacggcaacggggucgugacgaccagcggcaccuacgugagcgccaucgcccaggcgaaggccucccaggaggggccgcuccccgagaucgaggacgaggucuuccggaagcgcaaccugaccaucauggaccugcaccccggcagcgggaagacgcggcgcuaccucccggccaucgugcgcgaggccaucaagcggaagcugcgcacccugauccucgcccccacccggguggucgcguccgagauggccgaggcccugaagggcaugcccauccgcuaccagaccacggccgucaagagcgagcacaccggcaaggagaucguggaccugaugugccacgccaccuucaccaugcggcuccugucccccguccgcgugccgaacuacaacaugaucaucauggacgaggcgcacuucacggaccccagcuccaucgccgcccggggguacaucagcacccgcgugggcaugggggaggccgccgcgaucuucaugaccgccacgccgcccggcuccgucgaggccuucccgcagagcaacgccgugauccaggacgaggagcgggacauccccgagcgcuccuggaacagcggguacgaguggaucacggacuuccccggcaagaccgugugguucguccccuccaucaagagcggcaacgacaucgcgaacugccugcggaagaacgggaagcgcgugauccagcucucccggaagaccuucgacaccgaguaccagaagacgaagaacaacgacugggacuacguggucaccaccgacaucagcgagaugggcgccaacuuccgcgccgaccgggugaucgacccgcgccggugccugaagcccgugauccugaaggacgggcccgagcgcgucauccucgccggccccaugccggugaccgucgccuccgcggcccagcggcgcgggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccggcugcgcggcgaggcccggaagaccuucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacuccgacccccucgcgcugcgggaguucaaggaguucgccgccggccgccggagcgucuccggggaccugauccucgagaucggcaagcugccgcagcaccugacccagcgcgcccagaacgcgcucgacaaccuggugaugcugcacaacagcgagcagggcgggcgggccuaccgccacgccauggaggagcuccccgacaccaucgagacccugaugcugcucgcccugaucgccgugcugacgggcggggucacccucuucuuccuguccggccgggggcugggcaagaccagcaucggccuccugugcgugauggcguccagcgugcugcucuggauggccuccgucgagccccacuggaucgccgccagcaucauccuggaguucuuccugauggugcuccugauccccgagccggaccgccagcgcacgccccaggacaaccagcuggccuacguggucaucgggcuccuguucaugauccugaccguggcggccaacgagaugggccuccuggagacgaccaagaaggaccuggggaucggccacguggccgucgagaaccaccaccacgccgccaugcucgacguggaccugcaccccgcguccgccuggacccuguacgccguggccaccacgaucaucaccccgaugaugcggcacaccaucgagaacaccacggccaacaucagccucaccgcgaucgccaaccaggccgccauccugauggggcuggacaagggcuggcccaucuccaagauggacaucggcgucccccuccuggcgcuggggugcuacagccaggugaacccccucacccugaccgccgccgugcugaugcucgucgcccacuacgccaucaucggcccggggcugcaggcgaaggccacgcgcgaggcccagaagcggaccgccgccggcaucaugaagaaccccaccguggacgggaucguggcgaucgaccuggaccccgucguguacgacgccaaguucgagaagcagcucggccagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggcgaacaucuuccggggguccuaccuggccggcgccggccuggccuucagccucaugaagucccucgggggcgggcgccgggggacgggggcgcagggcgagacccugggcgagaaguggaagcgccagcucaaccagcuguccaagagcgaguucaacaccuacaagcgguccgggaucauggaggucgaccgcagcgaggccaaggagggccugaagcgcggggagaccacgaagcacgccgugucccgcggcaccgccaagcuccggugguucguggagcgcaaccuggucaagcccgaggggaaggugaucgaccugggcugcggccgcggcggguggagcuacuacugcgccgggcugaagaaggugaccgaggucaagggguacaccaagggcggccccggccacgaggagcccaucccgauggcgacguacggguggaaccucgugaagcugcacuccggcaaggacguguucuucaucccgcccgagaagugcgacacccugcucugcgacaucggggagagcucccccaacccgaccaucgaggagggccgcacccugcggguccugaagaugguggagcccuggcuccgcgggaaccaguucugcaucaagauccugaaccccuacaugcccagcguggucgagacgcuggagcagaugcagcggaagcacggcggcaugcucgugcgcaacccgcugucccgcaacagcacccacgagauguacuggguguccugcgggaccggcaacaucgucagcgccgugaacaugaccucccggaugcugcucaaccgcuucaccauggcccaccggaagcccacguacgagcgcgacguggaccugggggccggcacccggcacgucgccguggagcccgagguggcgaaccuggacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcuccugacgaagcccugggacgugauccccauggucacccagaucgccaugaccgacaccacgcccuucggccagcagcggguguucaaggagaagguggacacccgcaccccgaaggccaagcgggggaccgcgcagaucauggaggucacggccaaguggcuguggggcuuccucucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacacggccggcugggacacccgcaucaccgaggacgaccugcagaacgaggcgcggaucaccgacaucauggagccggagcacgcccuccuggccaaguccaucuucaagcugacguaccagaacaaggugguccgcgugcagcggcccgccaagaacgggaccgugauggacgucaucagccgccgggaccagcgcggcuccggccaggugggcaccuacggccucaacaccuucacgaacauggaggcccagcugauccggcagauggagagcgaggggaucuucucccccagcgagcuggagacccccaaccucgcggagcgcgugcuggacuggcuggagaaguacggcgucgagcggcucaagcgcauggccaucuccggggacgacugcguggugaagccgaucgacgaccgguucgccaccgcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcgcgcgugagccagggggccggcuggagccugcgggagacggccugccucgggaaguccuacgcccagauguggcagcugauguacuuccaccgccgggaccugcgccucgcggccaacgccaucugcagcgccguccccguggacuggauccccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugccguaccuggggaagcgcgaggaccaguggugcggcagccucaucggccugaccgcgcgggccacgugggccaccaacauccagguggccaucaaccagguccgccggcugaucgggaacgagaacuaccucgacuacaugaccuccaugaagcgcuucaagaacgagagcgaccccgagggcgcccugugguga

SEQ ID NO: 8685 - RNA, 9879 nt, Artificial Sequence
  derived and/or modified CDS sequence (opt1) from DENV-1__GU131786__SS-prME
agcgugaccaugcugcucaugcugaugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccccggcccgcggggcccggcgcauggcgauccucggcgccaccgccugggacuucgggagcaucggcggcguguuccccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcgggcggacagcgggugcgucaucaacuggaagggccgcgagcugaagugcgggagcggcaucuucgugaccaacgaggugcacaccuggaccgagcaguacaaguuccaggccgacucccccaagcggcucagcgccgccaucggcaaggccugggaggagggggucugcggcauccgcuccgcgacgcggcuggagaacaucauguggaagcagaucagcaacgagcugaaccacauccuccuggagaacgacaugaagcugaccgugguggucggggacguggccggcauccucgcccaggggaagaagaugauccgcccccagccgauggaguacaaguacuccuggaaguccuggggcaaggccaagaucaucggcgcggacgugcagaacaccaccuucaucaucgacgggcccaacacccccgagugccccgacgaccagcgggccuggaacaucugggaggucgaggacuacggcuucgggaucuucacgaccaacaucuggcugaagcugcgcgacagcuacacccaggugugcgaccaccggcucaugagcgccgccaucaaggacuccaaggccgugcacgcggacaugggcuacuggaucgagagcgagaagaacgagaccuggaagcuggcccgcgccuccuucaucgaggucaagacgugcaucuggcccaagucccacacccugugguccaacggcgugcucgagagcgagaugaucauccccaagaucuacgggggccccaucucccagcacaacuaccggccgggguacuucacccagaccgccggccccuggcaccuggggaagcuggagcucgacuucgaccugugcgagggcacgaccguggucguggacgagcacugcggcaaccgcgggcccagccugcggaccaccacggugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccucgggcugcugugcaucagcaucaugaucgaggaggugaugcggucccgcuggagccggaagaugcucaugaccggcacgcuggcgguguucuuccugcucaucauggggcagcugaccuggaacgaccugauccgccucugcaucauggucggcgccaacgccuccgaccgcauggggaugggcaccaccuaccuggcccugauggccacguucaagaugcggcccauguucgcggugggccuccuguuccgccggcugaccagccgcgaggugcuccugcugaccaucgggcucucccuggucgccagcguggagcugcccaacucccucgaggagcugggcgacgggcuggccaugggcaucaugauccucaagcugcugaccgacuuccagagccaccagcucugggccacgcugcugucccucaccuucauccggaccaccuucagccugcacuacgcguggaagacgauggccaugguccuguccaucgugagccucuucccccugugccuguccaccaccagccagaagaccacguggcuccccgugcugcugggcucccucgggugcaagccccugaccauguuccugaucgccgagaacaagaucuggggccgcaagagcuggccccucaacgaggggaucauggccgucggcaucgugagcauccugcuguccagccuccugaagaacgacgugccgcuggccgggccccucaucgcgggcggcaugcugaucgccugcuacgucaucuccgggagcuccgccgaccugagccucgagaaggccgccgugguguccugggaggaggaggcggagcacagcggcgccucccacaacauccuggucgaggugcaggacgacgggaccaugaagaucaaggacgaggagcgggacgacacccugacgauccuccugaaggccacccugcucgccgugagcggcgucuacccccuguccauccccgccacccuguucgugugguacuucuggcagaagaagaagcagcgcagcggggugcucugggacaccccgagcccgcccgaggucgagcgggcggugcuggacgacggcaucuaccgcaucaugcagcggggccugcuggggcgcagccaggugggcgucgggguguuccaggagaacguguuccacaccauguggcacgucacgcggggcgccgugcucauguaccaggggaagcgccuggagcccuccugggccagcgugaagaaggaccugaucuccuacggcggcggguggcggcuccagggcagcuggaacaccggggaggagguccaggugaucgccguggagccgggcaagaaccccaagaacguccagaccgcccccgggaccuucaagacguccgagggcgaggugggcgcgaucgcccuggacuucaagcccgggaccagcggcagcccgaucgugaaccgcgaggggaagaucgucggccuguacggcaacgggguggugaccaccuccggcacguacgucagcgccaucgcccaggcgaaggccucccaggaggggccccuccccgagaucgaggacgagguguuccggaagcgcaaccugaccaucauggaccugcacccgggcagcgggaagacccggcgcuaccuccccgccaucgugcgggaggccaucaagcgcaagcugcgcacccugauccucgcccccacgcgggucguggcguccgagauggccgaggcccugaagggcaugcccauccgcuaccagaccaccgccgucaagagcgagcacaccggcaaggagaucgucgaccugaugugccacgccacguucaccaugcggcuccuguccccggugcgcgugcccaacuacaacaugaucaucauggacgaggcgcacuucaccgaccccagcuccaucgccgcccggggguacaucagcacccgcgucggcaugggggaggccgccgcgaucuucaugacggccacgcccccgggcuccguggaggccuucccccagagcaacgccgugauccaggacgaggagcgggacauccccgagcgcuccuggaacagcggguacgaguggaucaccgacuuccccggcaagaccgucugguucgugccguccaucaagagcggcaacgacaucgcgaacugccugcggaagaacgggaagcgcgugauccagcucucccggaagacguucgacaccgaguaccagaagaccaagaacaacgacugggacuacgucgugaccacggacaucagcgagaugggcgccaacuuccgcgccgaccgggugaucgacccccgccggugccugaagcccgucauccugaaggacgggcccgagcgcgugauccucgccggcccgaugcccgucaccguggccuccgcggcccagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucaucccggcccuguucgagcccgagcgcgagaaguccgcggccaucgacggggaguaccggcugcgcggcgaggcccggaagacguucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccgcucgcgcugcgggaguucaaggaguucgccgccggccgccggagcguguccggggaccugauccucgagaucggcaagcugccccagcaccugacccagcgcgcccagaacgcgcucgacaaccuggugaugcugcacaacagcgagcagggcgggcgggccuaccgccacgccauggaggagcuccccgacacgaucgagacccugaugcugcucgcccugaucgccguccugaccggcggggugacccucuucuuccuguccggccgggggcugggcaagacgagcaucggccuccugugcgugauggcguccagcguccugcucuggauggccuccguggagccccacuggaucgccgccagcaucauccuggaguucuuccugauggugcuccugaucccggagcccgaccgccagcggacgccccaggacaaccagcuggccuacgucgugaucgggcuccuguucaugauccugaccguggcggccaacgagaugggccuccuggagaccaccaagaaggaccuggggaucggccacgucgccguggagaaccaccaccacgccgccaugcucgacguggaccugcacccggcguccgccuggacgcuguacgccgucgccaccaccaucaucacccccaugaugcgccacacgaucgagaacaccaccgccaacaucagccucaccgcgaucgccaaccaggccgccauccugauggggcuggacaagggcuggcccaucuccaagauggacaucggcgugccccuccuggcgcuggggugcuacagccaggugaacccgcucacgcugaccgccgccguccugaugcucguggcccacuacgccaucaucggccccgggcugcaggcgaaggccacccgcgaggcccagaagcggaccgccgccggcaucaugaagaaccccacgguggacgggaucgucgcgaucgaccuggaccccgugguguacgacgccaaguucgagaagcagcucggccagaucaugcugcugauccucugcaccucccagauccugcugaugcgcaccaccugggcccucugcgagagcaucacgcuggccaccggcccgcugaccacccucugggaggggucccccggcaaguucuggaacacgaccaucgccgucagcauggcgaacaucuuccgggggagcuaccuggccggcgccggccuggccuucucccucaugaagucccucgggggcgggcgccgggggaccggggcgcagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgccgugucccgcggcaccgccaagcuccggugguucgucgagcgcaaccuggugaagcccgaggggaaggugaucgaccugggcugcggccgcggcggguggagcuacuacugcgccgggcugaagaaggucacggaggugaagggguacaccaagggcgggcccggccacgaggagccgauccccauggcgaccuacggguggaaccucgugaagcugcacuccggcaaggacgucuucuucaucccgcccgagaagugcgacacccugcucugcgacaucggggagagcuccccgaaccccacgaucgaggagggccgcacccugcgggugcugaagaugguggagcccuggcuccgcgggaaccaguucugcaucaagauccugaaccccuacaugccgagcgucguggagacccuggagcagaugcagcggaagcacggcggcaugcucgugcgcaacccccugucccggaacagcacccacgagauguacugggucuccugcgggacgggcaacaucgugagcgccgugaacaugaccucccgcaugcugcucaaccgcuucaccauggcccaccggaagcccaccuacgagcgcgacgucgaccugggggccggcacccggcacguggccguggagcccgaggucgcgaaccuggacaucaucggccagcgcaucgagaacaucaagcacgagcacaagagcacguggcacuacgacgaggacaacccguacaagaccugggccuaccacggguccuacgaggugaagcccagcggcagcgccuccagcauggucaacgggguggugaagcuccugaccaagcccugggacgucauccccauggugacccagaucgccaugacggacaccaccccguucggccagcagcggguguucaaggagaaggucgacacccgcacgcccaaggccaagcgggggaccgcgcagaucauggaggugaccgccaaguggcuguggggcuuccucucccgcaacaagaagccccggaucugcacccgcgaggaguucacgcggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcgaagaucaccgacaucauggagcccgagcacgcccuccuggccaaguccaucuucaagcugaccuaccagaacaaggucgugcgcgugcagcgccccgccaagaacgggaccgucauggacgugaucagccggcgcgaccagcggggcuccggccaggugggcacguacggccucaacaccuucaccaacauggaggcccagcugauccgccagauggagagcgaggggaucuucucccccagcgagcuggagaccccgaaccucgcgggccggguccuggacuggcuggagaagcacgggguggagcgccucaagcggauggccaucuccggcgacgacugcguggucaagcccaucgacgaccgcuucgccacggcccugaccgcccugaacgacauggggaaggugcggaaggacaucccccagugggagcccagcaagggcuggaacgacuggcagcaggucccguucugcagccaccacuuccaccagcucaucaugaaggacggccgcgagaucgucgugcccugccggaaccaggacgagcugguggggcgcgcgcgggucucccagggcgccggguggagccugcgcgagaccgccugccucggcaaguccuacgcccagauguggcagcugauguacuuccaccggcgcgaccugcggcucgcggccaacgccaucugcagcgccgugcccguggacuggguccccaccucccgcacgaccuggagcauccacgcccaccaccaguggaugaccaccgaggacaugcuguccguguggaaccggguguggaucgaggagaacccguggauggaggacaagacgcacaucagcuccuggggcgacguccccuaccugggcaagcgcgaggaccaguggugcggcagccucaucgggcugaccgcgcgcgccaccugggccaccaacauccagguggccaucaaccaggugcggcgccugcucggcaacgagaacuaccuggacuacaugacguccaugaagcgguucaagaacgagagcgaccccgagggggcccugugguga

SEQ ID NO: 8686 - RNA, 9879 nt, Artificial Sequence
  derived and/or modified CDS sequence (opt1) from DENV-1__GU131787__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgggaugaaguucacggugguggucggcgacguggccgggauccucgcgcagggcaagaagaugauccggccccagcccauggaguacaaguacagcuggaaguccuggggcaaggccaagaucaucggggccgacgugcagaacaccaccuucaucaucgacggccccaacaccccggagugccccgacgaccagcgcgccuggaacaucugggaggucgaggacuacggguucggcaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccguggucguggacgagcacugcgggaaccggggcccgucccugcgcaccaccacggugaccgggaagaucauccacgaguggugcugccggagcugcacccugccgccccuccgcuuccggggcgaggacgggugcugguacggcauggagauccgccccgucaaggagaaggaggagaaccuggugaaguccauggugagcgccggcagcggggaggucgacuccuucagccucggccugcugugcaucuccaucaugaucgaggaggugaugcggagccgcuggucccggaagaugcucaugaccgggacgcuggccguguucuuccugcucaucaugggccagcugaccuggaacgaccugauccgccucugcaucauggucggggccaacgcgagcgaccgcaugggcaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggggacggccuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcuggggagccucggcugcaagccgcugaccauguuccugaucgcggagaacaagaucugggggcggcgcuccuggccccucaacgagggcaucauggccgucgggaucgugagcauccugcugagcucccuccugaagaacgacgugccccuggccggcccccucaucgccggcgggaugcugaucgccugcuacgucaucagcggcuccagcgcggaccugucccucgagaaggccgccgaggugagcugggaggaggaggccgagcacuccggggccagccacaacauccugguggagguccaggacgacggcaccaugaagaucaaggacgaggagcgggacgacacccugaccauccuccugaaggcgacgcugcucgccguguccgggguguacccgcugagcauccccgccacccuguucgucugguacuucuggcagaagaagaagcagcgcuccggcgugcucugggacacccccagcccgcccgagguggagcgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccggaucacggaggacgaccugcagaacgaggcccgcaucaccgacaucauggagccggagcacgcccuccuggcgcgcuccaucuucaagcugaccuaccagaacaaggugguccgggugcagcgccccgccaagaacggcaccgugauggacgucaucagccggcgcgaccagcggggguccggccaggugggcacguacgggcucaacaccuucaccaacauggaggcccagcugauccgccagauggagagcgagggcaucuucucccccagcgagcuggagacccccaaccucgccgagcgggugcuggacuggcuggagaaguacggggucgagcgccucaagcggauggccaucuccggcgacgacugcguggugaagccgaucgacgaccgcuucgcgacggcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgcgugccucggcaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgggaggaccaguggugcggcagccucaucgggcugaccgcccgcgccaccugggcgaccaacauccagguggccaucaaccagguccggcgccugaucggcaacgagaacuaccucgacuacaugaccuccaugaagcgguucaagaacgagagcgaccccgagggggcccugugguga

SEQ ID NO: 8687 - RNA, 9879 nt, Artificial Sequence
  derived and/or modified CDS sequence (opt1) from DENV-1__HM181968__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggggagcugugcgaggacaccaugaccuacaagugcccccggaucaccgaggccgagcccgacgacguggacugcuggugcaacgccacggacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggccacgcagaacggccggcugaucaccgccaacccgaucgucaccgacaaggagaagcccgugaacaucgaggcggagccgcccuucggggaguccuacaucgugaucggcgccggcgagaaggcccugaagcucagcugguucaagaagggguccagcaucggcaagauguucgaggccaccgcccgcggggcgcggcgcauggccauccugggcgacacggccugggacuucggguccgucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgugggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucgccaccaacaucuggcugaagcugcgggacagcuacacccaggugugcgaccaccgccucauguccgccgccaucaaggacagcaaggccgugcacgcggacaugggcuacuggaucgaguccgagaagaacgagaccuggaagcuggcccgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccguggucguggacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggcgguguuccugcuccugaucauggggcagcugaccuggaacgaccucauccggcugugcaucauggucggcgccaacgccagcgaccgcauggggaugggcacgaccuaccuggcccucauggccaccuucaagaugcgcccgauguucgcggugggccugcugcuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggccacccuccugagccugaccuucaucaagacgacccucucccugcacuacgcguggaagaccauggccaugguccugagcaucgugucccucuucccccugugccugagcaccacgucccagaagaccaccuggcuccccgugcugcugggcagcuucgggugcaagccgcucaccauguuccugaucacggagaacaagaucuggggccgcaaguccuggccccugaacgaggggaucauggccgucggcguggugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccggacccugauccuggcccccacccgcgucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggucacgguggccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgggagaaguccgccgcgaucgacggggaguaccgccugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccucuucaugauccugacgguggccgcgaacgagaugggccugcucgagaccaccaagaaggaccuggggaucggccacgucgccguggagaaccaccaccacgccaccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgggaggcgcagaagcgcaccgccgccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgucagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgcggugucccggggcaccgccaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgccgugaacaugacgucccggaugcugcugaaccgcuucaccauggcgcaccgcaagcccaccuacgagcgggacgucgaccucggggccggcacccgccacguggccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcucaccaagcccugggacgucauccccauggugacccagaucgccaugacggacaccacccccuucggccagcagcgcguguucaaggagaaggucgacacccggacgccgaaggccaagcgcgggaccgcccagaucauggaggugaccgcccgguggcuguggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucacggaggacgaccugcagaacgaggccaagaucaccgacaucauggagccggagcacgcccugcucgcgaccuccaucuucaagcugaccuaccagaacaaggucgugcgggugcagcgccccgccaagaacgggacggucauggacgugaucagccgccgggaccagcgcggcuccggccaggugggcaccuacggccugaacaccuucaccaacauggaggcccagcucauccggcagauggagagcgaggggaucuuccugcccuccgagcuggagacgcccaaccucgccgagcgcguccuggacuggcuggagaaguacggcguggagcggcucaagcgcauggccaucagcggggacgacugcguggucaagccgaucgacgaccgguucgcgaccgcccugaccgcccugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcuggugggccgggcccgcgucucccagggggccggcuggagccugcgggagaccgcgugccucggcaagagcuacgcccagauguggcagcugauguacuuccaccgccgggaccugcgccucgccgccaacgcgaucugcuccgccgugcccaucgacugggugcccacgagccggaccaccugguccauccacgcccaccaccaguggaugaccacggaggacaugcugagcgucuggaaccgcguguggaucgaggagaaccccuggauggaggacaagacccacguguccagcuggggcgacgucccguaccuggggaagcgggaggaccaguggugcggcucccucaucggccugaccgcccgcgccaccugggcgagcaacauccagguggccaucaaccaggugcgccggcugaucgggaacgagaacuaccucgacuacaugaccuccaugaagcgcuucaagaacgagggcgaccccgagggggcccugugguga

SEQ ID NO: 8688 - RNA, 9879 nt, Artificial Sequence
  derived and/or modified CDS sequence (opt1) from DENV-1__GU131789__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacgcucauccuggcccccacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccucaaggacgggcccgagcgcgugauccuggcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggucaugcuccacaacagcgagcagggcgggcgggccuaccgccacgccauggaggagcugcccgacaccaucgagacccugaugcuccuggcgcugaucgccgugcucaccggcggggugacccuguucuuccuguccggccgggggcucggcaagacgagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcggacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcacggggaacaucgugagcgccgucaacaugaccucccgcaugcuccugaaccgcuucaccauggcccaccggaagcccaccuacgagcgcgacguggaccugggcgcgggcacgcggcacguggccgucgagcccgagguggccaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgggucuucaaggagaagguggacacgcgcaccccgaaggccaagcggggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaagguggugcgcguccagcggcccgcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccauccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgaccccgagggggcccugugguga

SEQ ID NO: 8689 - RNA, 9879 nt, Artificial Sequence
  derived and/or modified CDS sequence (opt1) from DENV-1__GU131790__SS-prME
agcgugaccaugcugcugaugcuggugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgucggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggucacgcccuccauggccaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggcgaagaucuccaacaccacgaccgacagccgcugcccgacccagggcgaggccacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcgcccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcgucuucaccagcguggggaagcuggugcaccagaucuucggcaccgccuacgggguccucuucuccggcgugagcuggacgaugaagaucgggaucggcgugcugcugaccuggcucggccugaacucccgcagcaccucccugagcaugaccugcaucgccgucgggcucgugacgcuguaccugggcgugaugguccaggccgacuccgggugcgugaucaacuggaagggccgggagcucaagugcgggagcggcaucuucgugaccaacgagguccacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacgguggucgugggggacguggccggcauccucgcgcaggggaagaagaugauccggccccagcccauggaguacaaguacagcuggaaguccuggggcaaggccaagcugaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggugugcgaccaccgccugauguccgcggccaucaaggacagcaaggccguccacgccgacaugggcuacuggaucgaguccgagaagaacgagaccuggaagcuggcccgggcgagcuucaucgaggugaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgucgugguggacgagcacugcggcaaccgggggccgucccuccgcaccaccacggucaccggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacgcuggccgucuucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgugggccugcuguuccgccggcucaccucccgcgagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcgugaagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8690 - RNA, 9879 nt, Artificial Sequence
  derived and/or modified CDS sequence (opt1) from DENV-1__GU131791__SS-prME
agcgugaccaugcugcucaugcugaugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggccgaugaagaucaaggacgaggagcgcgacgacacccugaccauccuccugaaggccacccugcucgccguguccggcguguacccccugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaacccgaagaacgugcagacggcccccgggaccuucaagacccccgagggcgaggucggcgccaucgcgcuggacuucaagcccgggaccagcggcuccccgaucgugaaccgggaggggaagaucgugggccuguacggcaacggggucgugacgaccagcggcaccuacgugagcgccaucgcccaggccaaggcgucccaggaggggccccuccccgagaucgaggacgaggucuuccgcaagcggaaccugaccaucauggaccugcacccgggcagcgggaagacgcgccgguaccuccccgccaucgugcgcgaggccaucaagcgcaagcugcggacccugauccucgcccccacccgcguggucgccuccgagauggcggaggcccugaagggcaugcccauccgguaccagaccacggccgucaagagcgagcacaccggcaaggagaucguggaccugaugugccacgccaccuucaccaugcgccuccuguccccgguccgggugcccaacuacaacaugaucaucauggacgaggcccacuucacggaccccagcuccaucgcggcccgcggguacaucagcacccgggugggcaugggggaggccgccgccaucuucaugaccgcgacgccgcccggcuccgucgaggccuucccccagagcaacgccgugauccaggacgaggagcgcgacauccccgagcgguccuggaacagcggguacgaguggaucacggacuuccccggcaagaccgugugguucguccccuccaucaagagcggcaacgacaucgccaacugccugcgcaagaacgggaagcgggugauccagcucucccgcaagaccuucgacaccgaguaccagaagacgaagaacaacgacugggacuacguggucaccaccgacaucagcgagaugggcgcgaacuuccgggccgaccgcgugaucgacccccggcgcugccugaagcccgugauccugaaggacgggcccgagcgggucauccucgccggcccgaugcccgugaccgucgccuccgccgcgcagcgccgggggcgcaucggccgcaaccacaacaaggagggcgaccaguacaucuacauggggcagccccugaacaacgacgaggaccacgcccacuggacggaggccaagaugcugcucgacaacaucaacacccccgagggcaucaucccggcccuguucgagcccgagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggacguacuccgacccgcucgcccugcgcgaguucaaggaguucgcggccggccggcgcagcgucuccggggaccugauccucgagaucggcaagcugccccagcaccugacccagcgggcccagaacgcccucgacaaccuggugauccugcacaacagcgagcagggcgggcgcgcguaccggcacgccauggaggagcuccccgacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugaucccggagcccgaccggcagcgcacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcacccggccuccgcguggacccuguacgccguggccaccacgaucaucacccccaugaugcgccacaccaucgagaacaccacggccaacaucagccucaccgccaucgcgaaccaggccgccauccugauggggcuggacaagggcuggcccaucuccaagauggacaucggcgucccccuccuggcccuggggugcuacagccaggugaacccgcucacccugaccgcggccgugcugaugcucgucgcccacuacgccaucaucggccccgggcugcaggccaaggcgacgcgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcaccucccagauccugcugaugcggacgaccugggcccucugcgagagcaucacccuggccaccggcccgcugacgacccucugggaggggucccccggcaaguucuggaacaccaccaucgccgugagcauggccaacaucuuccgcggguccuaccuggcgggcgccggccuggccuucagccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagaccacgaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcggccccggccacgaggagccgauccccauggccacguacggguggaaccucgugaagcugcacuccggcaaggacguguucuucaucccgcccgagaagugcgacacccugcucugcgacaucggggagagcuccccgaaccccaccaucgaggagggccggacccugcgcguccugaagaugguggagcccuggcuccgggggaaccaguucugcaucaagauccugaaccccuacaugccgagcguggucgagacgcuggagcagaugcagcgcaagcacggcggcaugcucgugcggaacccccugucccgcaacagcacccacgagauguacuggguguccugcgggaccggcaacaucgucagcgcggugaacaugaccucccgcaugcugcucaaccgguucaccauggcccaccgcaagcccacguacgagcgggacguggaccugggggccggcacccgccacgucgccguggagcccgagguggccaaccuggacaucaucggccagcggaucgagaacaucaagcacgagcacaagagcaccuggcacuacgacgaggacaacccguacaagaccugggcguaccacggguccuacgaggucaagcccagcggcuccgccagcagcauggugaacggggucgugaagcuccugacgaagcccugggacgugauccccauggucacccagaucgccaugaccgacaccacgccguucggccagcagcgcguguucaaggagaagguggacacccggacccccaaggccaagcgcgggaccgcccagaucauggaggucacggcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcccgcaucaccgacaucauggagcccgagcacgcgcuccuggccaaguccaucuucaagcugacguaccagaacaaggugguccgggugcagcgccccgccaagaacgggaccgugauggacgucaucagccggcgcgaccagcggggcuccggccagguggggaccuacggccucaacaccuucacgaacauggaggcccagcugauccgccagauggagagcgaggggaucuucucccccagcgagcuggagaccccgaaccucgccgagcgggugcuggacuggcuggagaaguacggcgucgagcgccucaagcggauggcgaucuccggggacgacugcguggugaagcccaucgacgaccgcuucgccaccgcccugaccgcccugaacgacaugggcaagguccggaaggacaucccccagugggagcccagcaagggguggaacgacuggcagcaggucccguucugcucccaccacuuccaccagcucaucaugaaggacggccgcgagaucgugguccccugccggaaccaggacgagcuggugggccgcgcccgggugagccagggggcgggcuggagccugcgcgagacggccugccucgggaaguccuacgcccagauguggcagcugauguacuuccaccggcgcgaccugcggcucgccgcgaacgccaucugcagcgccguccccguggacuggauccccaccucccgcaccaccuggagcauccacgcccaccaccaguggaugacgaccgaggacaugcuguccguguggaaccgcgucuggaucgaggagaacccguggauggaggacaagacccacaucagcuccuggggcgacgugcccuaccuggggaagcgggaggaccaguggugcggcagccucaucggccugaccgcccgcgcgacgugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8691 - RNA, 9879 nt, Artificial Sequence
  derived and/or modified CDS sequence (opt1) from DENV-1__GU131792__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccacggacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcggguggagcccugggcccuccgccaccccggguucacggugaucgcccuguuccuggcgcacgccaucggcaccuccaucacccagaaggggaucaucuucauccuccugaugcuggugacccccagcauggccaugcggugcgucggcaucggcucccgcgccuucguggaggggcucagcggcgccacguggguggacgucgugcuggagcacggguccugcgugaccaccauggcgaaggacaagcccacccuggacaucgagcuccugaagacggaggucaccaacccggccgugcugcggaagcucugcaucgaggccaagaucagcaacaccaccacggacucccgcugccccacccagggcgaggccacccugauggaggagcaggacgccaccuucgugugccggcgcacguucgucgaccggggcugggggaacggcugcgggcuguucggcaaggggagccucaucacgugcgcgaaguucaagugcgugaccaagcuggagggcaagaucgugcaguacgagaaccugaaguacuccgucaucgugaccgugcacacgggcgaccagcaccaggucgggaacgagagcaccgagcacggcaccaccgccaccaucacgccccaggcccccaccuccgagauccagcucccggacuacggggcccugacccuggacugcagcccccgcaccggccucgacuucaacgagauggugcugcugacgaugaaggagaaguccuggcucguccacaagcagugguuccuggaccugccccuccccuggaccagcggggccagcaccucccaggagaccuggaaccggcaggaccugcuggugacguucaagaccgcgcacgccaagaagcaggagguggucgugcucggcagccaggagggcgccaugcacaccgggcugaccggcgccacggagauccagaccuccgggaccaccacgaucuucgccggccaccugaagugccgccucaagauggacaagcugacccugaaggggaugagcuacgugaugugcaccggcuccuucaagcucgagaaggaggucgcggagacccagcacggcacggugcuggugcagaucaaguacgaggggaccgacgccccgugcaagauccccuucagcacccaggacgagaagggcgucacccagaacgggcggcugaucacggccaaccccaucgugaccgacaaggagaagcccgugaacaucgaggccgagccgcccuucggcgaguccuacaucgucaucggcgcgggggagaaggcccugaagcucagcugguucaagaagggcuccagcaucgggaagauguucgaggccaccgcccgcggcgcccggcgcauggcgauccugggggacaccgccugggacuucggcuccgugggcgggguguucacgagcgucggcaagcuggugcaccagaucuucgggaccgccuacggcguccuguucuccggggucagcuggaccaugaagaucggcaucggcgugcugcugaccuggcucgggcugaacucccgcagcacgucccugagcaugaccugcaucgccgugggccucgucacccuguaccugggggugauggugcaggccgacuccggcugcgucaucaacuggaaggggcgggagcucaagugcggcagcggcaucuucgggaccaacgaggugcacacguggaccgagcaguacaaguuccaggcggacagccccaagcgccuguccgccgccaucggcaagcccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcccagggcaagaagaugauccggccgcagcccauggagcacaaguacagcuggaaguccugggggaaggcgaagaucaucggcgccgacgugcagaacaccacguucaucaucgacgggcccaacacccccgagugcccggacgaccagcgcgccuggaacaucugggaggucgaggacuacggcuucggcaucuucaccaccaacaucuggcugaagcugcgggacagccacacccaggugugcgaccaccgccucauggccgcggccaucaaggaccggaaggccgugcacgccgacaugggguacuggaucgaguccgagaagaacgagcccuggaagcuggcccgcgcgagcuucaucgaggucaagaccugcaucuggcccaagucccacacccuguggagcaacggcgugcucgaguccgagaugaucaucccgaagaucuacgggggccccaucagccagcacaacuaccggcccggguacuucacccagacggccggccccuggcaccugggcaagcuggagcucgacuucgaccugugcgaggggaccaccguggucguggacgagcacugcggcaaccgcgggccgucccugcggaccacgaccgugaccggcaagaucauccacgaguggugcugccgcagcugcacccugccgccccuccgguucaagggggaggacggcugcugguacggcauggagauccgccccgucaaggagaaggaggagaaccuggugaaguccauggugagcgccggguccggcgaggucgacagcuucagccucgggcugcugugcaucuccaucaugaucgaggaggugaugcggagccgcuggucccggaagaugcucaugacgggcacccuggccguguuccugcuccugaucauggggcagcugaccuggaacgaccucauccgccugugcaucauggucggcgccaacgcgagcgaccgcaugggcauggggaccacguaccuggcccucauggccaccuucaagaugcggccgauguucgccgugggccugcuguuccgccggcucaccucccgcgaggugcugcugcucaccaucgggcugagccuggucgccuccguggagcuccccaacagccuggaggagcugggcgacggccucgcgauggggaucaugauccugaagcugcucacggacuuccagucccaccagcugugggccacccugcucagccugaccuucaucaagaccacgcugucccuccacuacgccuggaagaccauggccaugguccugagcaucgugucccuguucccccucugccugagcaccaccucccagaagacgaccuggcugcccgugcuccugggcagccuggggugcaagccgcucaccauguuccugaucaccgagaacaagaucuggggccggaaguccuggccccugaacgaggggaucauggcggucggcguggugagcauccuccuguccagccugcucaagaacgacgucccccuggccggcccccugaucgccgggggcaugcucaucgccugcuacgugaucagcggguccagcgccgaccugucccuggagaaggcggccgaggugagcugggaggaggaggccgagcacuccggcgccagccacaacauccucgucgaggugcaggacgacgggacgaugaagaucaaggacgaggagcgcgacgacacccugaccauccugcucaaggccacccugcuggcgguguccggcgucuacccgcucagcauccccgccacccuguucgugugguacuucuggcagaagaagaagcagcgguccggcgugcugugggacacgcccagcccgcccgaggucgagcgcgccgugcuggacgacgggaucuaccggaucaugcagcgcggccuccuggcccggucccaggugggggucggcguguuccaggagaacguguuccacaccauguggcacgucacccgcggggccgugcugauguaccagggcaagcggcucgagcccagcugggcguccgugaagaaggaccugaucagcuacggcgggggcuggcgccugcagggguccuggaacaccggcgaggagguccaggugaucgccguggagcccgggaagaaccccaagaacguccagacggcccccggcaccuucaagacccccgagggcgaggugggggccaucgcccucgacuucaagcccggcaccagcggguccccgaucgugaaccgggagggcaagaucgucggccuguacgggaacggcguggugacgaccagcgggaccuacgucuccgcgaucgcccaggccaaggccagccaggagggcccccugcccgagaucgaggacgagguguuccgcaagcggaaccucaccaucauggaccugcaccccgggagcggcaagacgcgccgguaccugccggcgaucgugcgcgaggccaucaagcggaagcuccgcacccugauccuggcccccacccgcgucguggccuccgagauggccgaggcgcucaagggcaugcccauccgguaccagaccacggccgucaagagcgagcacaccgggaaggagaucgucgaccugaugugccacgccaccuucaccaugcgccugcucucccccgugcgggugccgaacuacaacaugaucaucauggacgaggcccacuucacggaccccagcuccaucgccgcgcgcggcuacaucagcacccgggucgggaugggcgaggccgccgccaucuucaugaccgccacgccgcccggguccguggaggcguucccgcagagcaacgccgugauccaggacgaggagcgcgacauccccgagcgguccuggaacagcggcuacgaguggaucacggacuuccccggcaagaccgucugguucgugcccuccaucaagagcgggaacgacaucgccaacugccugcgcaagaacggcaagcgggugauccagcugucccgcaagaccuucgacaccgaguaccagaagacgaagaacaacgacugggacuacgucgugaccaccgacaucagcgagaugggggccaacuuccgggcggaccgcgugaucgacccgcggcgcugccucaagcccgucauccugaaggacggccccgagcgggugauccuggccgggcccaugccggucaccguggccuccgccgcccagcgccggggccgcaucggccggaaccacaacaaggagggggaccaguacaucuacaugggccagccccucaacaacgacgaggaccacgcgcacuggacggaggccaagaugcugcuggacaacaucaacacccccgaggggaucauccccgcccucuucgagccggagcgcgagaaguccgccgccaucgacggcgaguaccgccugcgcggggaggcgcgcaagaccuucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggacguacagcgacccccuggcccuccgcgaguucaaggaguucgccgcggggcggcgcagcguguccggcgaccugauccuggagaucggcaagcucccgcagcaccugacccagcgggcccagaacgcccuggacaaccucgugaugcugcacaacagcgagcagggcgggcgcgccuaccggcacgcgauggaggagcugcccgacaccaucgagacccucaugcugcuggcccucaucgccguccugaccggcggggugacccuguucuuccucuccgggcgcgggcugggcaagaccagcaucgggcugcucugcgugauggccuccagcguccugcuguggauggccuccguggagccccacuggaucgcggccagcaucauccucgaguucuuccugauggugcugcucaucccggagcccgaccggcagcgcacgccccaggacaaccagcuggccuacgucgugaucggccuccucuucaugauccugaccguggccgccaacgagauggggcugcucgagacgaccaagaaggaccugggcaucgggcacgucgcgguggagaaccaccaccacgccaccaugcuggacguggaccuccaccccgccuccgccuggacccuguacgccgucgcgacgaccaucaucaccccgaugaugcggcacaccaucgagaacacgaccgccaacaucagccugaccgccaucgccaaccaggccgcgauccucaugggccuggacaagggcuggcccaucuccaagauggacaucggggugccccugcucgcccugggcugcuacagccaggugaacccccugacccucacggccgccguccugaugcugguggcgcacuacgccaucaucgggccgggccuccaggccaaggccacccgcgaggcccagaagcgcaccgcggccgggaucaugaagaaccccaccguggacggcaucgucgccaucgaccuggaccccgugguguacgacgccaaguucgagaagcagcugggccagaucaugcuccugauccugugcacgucccagauccuccugaugcggaccaccugggcccugugcgagagcaucacccucgcgacggggccccugaccacccugugggagggcuccccggggaaguucuggaacaccacgaucgccgucagcauggccaacaucuuccgcggcuccuaccucgccggcgccgggcuggcguucagccugaugaagucccucggcgggggccggcgcgggaccggcgcccagggcgagacccugggggagaaguggaagcggcagcugaaccagcucagcaagagcgaguucaacaucuacaagcgcuccggcaucauggagguggaccggagcgaggccaaggaggggcugaagcgcggcgagaccacgcggcacgccgugucccgcgggaccgcgaagcugcggugguucgucgagcgcaaccuggugaagcccgagggcaaggugaucgaccucggcugcgggcggggcggguggagcuacuacugcgccggccugaagaaggucaccgaggugaagggguacaccaagggcggccccgggcacgaggagcccaucccgauggccacguacggcuggaaccuggugaagcuccacuccgggaaggacgucuucuucacgccgcccgagaagugcgacacccugcugugcgacaucggcgagagcucccccaacccgaccaucgaggaggggcgcacgcuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcaccgggaacaucgugagcgccgugaacaugaccucccgcaugcugcugaaccgcuucacgauggcccaccggaagcccaccuacgagcgcgacgucgaccucggcgcgggcacccggcacguggccguggagcccgaggucgccaaccuggacaucaucgggcagcgcaucgagaacaucaagcacgagcacaagagcaccuggcacuacgacgaggacaaccccuacaagacgugggccuaccacggcuccuacgaggugaagccgagcggguccgccagcuccauggucaacggcguggugaagcugcucaccaagcccugggacgucauccccauggugacccagaucgcgaugaccgacacgaccccguucgggcagcagcggguguucaaggagaaggucgacacccgcacccccaaggccaagcggggcacggcccagaucauggaggugaccgcccgcuggcuguggggcuuccugagccggaacaagaagccccgcaucugcacccgggaggaguucacccgcaaggugcggagcaacgccgcgaucggggccgucuucguggacgagaaccaguggaacuccgccaaggaggccguggaggacgagcgcuucugggaccucguccagaaggagcgggagcugcacaagcagggcaagugcgcgacgugcguguacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgcggacgacaccgccgggugggacacccggaucaccgaggacgaccugcagaacgaggccaagaucacggacaucauggagccggagcacgcccugcucgccaccuccaucuucaagcugaccuaccagaacaaggucgugcgcgugcagcgccccgcgaagaacggcaccgucauggacgugaucagccggcgcgaccagcggggguccggccaggugggcacguacgggcugaacaccuucaccaacauggaggcccagcucauccgccagauggagagcgagggcaucuuccugcccuccgagcuggagacccccaaccucgccgagcggguccuggacuggcuggagaaguacgggguggagcgccucaagcggauggccaucagcggcgacgacugcguggucaagccgaucgacgaccgcuucgccacggcgcugaccgcccugaacgacauggggaaggugcggaaggacaucccccagugggagcccuccaagggcuggaacgacuggcagcagguccccuucugcagccaccacuuccaccagcucaucaugaaggacggccgcgagaucgucgugccgugccggaaccaggacgagcugguggggcgcgcccgggucucccagggcgccggguggagccugcgcgagaccgccugccucggcaaguccuacgcgcagauguggcagcugauguacuuccaccggcgcgaccugcggcucgccgccaacgccaucugcagcgcggugcccguggacuggguccccaccagccgcacgaccugguccauccacgcccaccaccaguggaugaccaccgaggacaugcugagcguguggaaccggguguggaucgaggagaaccccuggauggaggacaagacgcacgucuccagcuggggcgacgugccguaccugggcaagcgcgaggaccaguggugcggcucccucaucgggcugaccgcccgcgccaccugggccagcaacauccagguggcgaucaaccagguccggcgccugaucggcaacgagaacuaccucgacuacaugaccuccaugaagcgguucaagaacgagggggaccccgagggcgcccugugguga

SEQ ID NO: 8692 - RNA, 9879 nt, Artificial Sequence
  derived and/or modified CDS sequence (opt1) from DENV-1__HM488256__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagaccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggaugagcuccgagggcgccuggaagcagauccagcgggucgagacgugggcccuccgccacccgggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcuccccgacuacggggcccugacccuggacugcagcccgcgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggccgagacgcagcacggcaccgugcuggugcagaucaaguacgagggcaccgacgcgcccugcaagaucccguucagcacccaggacgagaagggggucacgcagaacggccggcugaucaccgccaaccccaucgugaccgacaaggagaagcccgugaacaucgaggccgagcccccguucggggaguccuacaucgucaucggcgccggcgagaaggcgcucaagcugagcugguucaagaagggguccagcaucggcaagauguucgaggccaccgcccgcggggcccggcgcauggccauccugggcgcgcccgccugggacuucggguccaucggcggcguguucacgagcguggggaagcucguccaccagaucuucggcaccgccuacggggugcuguucuccggcgugagcuggaccaugaagaucgggaucggcguccugcucaccuggcugggccugaacucccgcagcacgucccucagcaugaccugcaucgccguggggcuggugacccuguaccucggcgucauggugcaggccgacuccgggugcgugaucaacuggaagggccgggagcugaagugcgggagcggcaucuucgucaccaacgaggugcacacguggaccgagcaguacaaguuccaggcggacagccccaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagccgauggagcacaaguacagcuggaaguccuggggcaaggccaagaucaucggcgccgacgugcagaacaccacguucaucaucgacgggcccaacacccccgagugccccgacgaccagcgcgcguggaacaucugggagguggaggacuacggcuucgggaucuucaccaccaacaucuggcugaagcuccgggacagcuacacgcaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucugggccaagucccacacccucuggagcaacggcguccuggaguccgagaugaucaucccgaagaucuacgggggccccaucagccagcacaacuaccgccccggguacuucacgcagaccgccggcccguggcaccuggggaagcucgagcuggacuucgaccugugcgagggcaccaccgugguggucgacgagcacugcggcaaccgggggcccucccuccgcacgaccaccgugaccggcaagaucauccacgaguggugcugccggagcugcacgcugccgccccugcgcuuccgcggggaggacggcugcugguacgggauggagaucuccccggugaaggagaaggaggagaaccucgucaagagcauggugagcgccggcuccggcgagguggacagcuucucccuggggcugcucugcaucagcaucaugaucgaggaggucaugcgcucccgguggagccgcaagaugcugaugaccggcacccuggcgguguucuuccuccugaucguggggcagcugcccuggaacgaccucauccggcugugcaucauggucggcgccaccgccuccgcccgcauggggaugggcacgaccagccuggcccucauggcgaccuucaagaugcgccccauguucgccgugggccugcuguuccggcgccucaccucccgggaggugcugcugcucacgaucgggcugagccuggucgccuccguggagcuccccaacagccuggaggagcugggcgacgggcucgccaugggcaucaugauccugaagcugcucaccgacuuccagucccaccagcugugggcgacccugcucagccugaccuucaucaagacgaccuucucccugcacuacgccuggaagaccauggccaugggccucagcgucgugucccuguucccgcugugccucagcaccacgucccagaagaccaccuggcugcccgugcugcucgggagccugggcugcaagccccugaccauguuccucaucgccgagaacaagaucugggggcgccggagcuggccccugaacgagggcaucauggccgucgggaucguguccauccugcucagcucccugcugaagaacgacgugccgcucgcgggcccccugaucgccggcgggaugcugaucgccugcuacgucaucagcggcuccagcgccgaccucucccuggagaaggccgcggaggugagcugggaggaggaggccgagcacuccggggccagccacaacauccugguggagguccaggacgacggcacgaugaagaucaaggacgaggagcgcgacgacacccucaccauccugcugaaggccacccuccuggccguguccgggguguacccccugagcauccccgcgacccucuucgucugguacuucuggcagaagaagaagcagcgguccggcgugcugugggacacgccguccccgcccgagguggagcgcgccguccuggacgacggcaucuaccggaucaugcagcgcgggcugcucggccggucccaggugggggugggcgucuuccaggagaacguguuccacaccauguggcacgugacccgcggggccguccugauguaccagggcaagcggcuggagcccagcugggccuccgugaagaaggaccucaucagcuacggcgggggcuggcgccugcagggguccuggaacaccggcgaggaggugcaggucaucgccguggagccggggaagaaccccaagaacgugcagacggcgcccggcaccuucaagacccccgagggcgaggucggggccaucgcccuggacuucaagccgggcaccagcgggagccccaucgugaaccgggagggcaagaucgugggccucuacgggaacggcgucgugacgaccuccgggaccuacgugagcgccaucgcgcaggccaaggccucccaggagggcccccugccggagaucgaggacgaggucuuccgcaagcggaaccugaccaucauggaccuccaccccgggagcggcaagacgcgccgguaccugcccgccaucgugcgcgaggccaucaagcggaagcugcgcacccucauccuggcgcccacccgcguggucgccuccgagauggccgaggcccugaagggcaugccgauccgguaccagaccacggccgucaagagcgagcacaccgggaaggagaucguggaccucaugugccacgcgaccuucaccaugcgccugcugucccccguccgggugcccaacuacaacaugaucaucauggacgaggcccacuucacggaccccagcuccaucgccgcccgcggcuacaucagcacccggguggggaugggcgaggccgcggccaucuucaugaccgccaccccgcccggguccgucgaggccuucccccagagcaacgcggugauccaggacgaggagcgcgacauccccgagcgguccuggaacagcggcuacgaguggaucacggacuucccgggcaagaccgugugguucguccccuccaucaagagcgggaacgacaucgccaacugccuccgcaagaacggcaagcgggugauccagcugucccgcaagaccuucgacaccgaguaccagaagacgaagaacaacgacugggacuacguggucaccaccgacaucagcgagaugggggccaacuuccgggccgaccgcgugaucgacccccggcgcugccugaagcccgugauccucaaggacggcccggagcgggucauccuggccgggcccaugcccgugaccgucgcguccgccgcccagcgccggggccgcaucggccggaaccacaacaaggagggggaccaguacaucuacaugggccagccccugaacaacgacgaggaccacgcccacuggacggaggccaagaugcuccuggacaacaucaacaccccggaggggaucauccccgcgcuguucgagcccgagcgcgagaaguccgccgccaucgacggcgaguaccgccuccgcggggaggcccgcaagaccuucguggagcugaugcggcgcggcgaccugcccguguggcucagcuacaaggucgccuccgagggcuuccaguacagcgaccggcgcuggugcuucgacggggagcggaacaaccaggugcuggaggagaacauggacguggagaucuggaccaaggagggcgagcgcaagaagcugcggccgcgcuggcucgacgcgcggacguacuccgacccccuggcccugcgcgaguucaaggaguucgccgccgggcggcgcagcgucuccggcgaccucauccuggagaucggcaagcugccccagcaccucacccagcgggcgcagaacgcccuggacaaccuggugaugcuccacaacagcgagcagggcgggcgcgccuaccggcacgccauggaggagcugcccgacaccaucgagacccugaugcuccuggcccugaucgcggugcucaccggcggggucacccuguucuuccuguccgggcgcgggcucggcaagaccagcaucgggcugcugugcgugauggccuccagcgugcuccuguggauggccuccgucgagccgcacuggaucgccgccagcaucauccuggaguucuuccucauggugcugcugauccccgagcccgaccggcagcgcaccccgcaggacaaccagcucgcguacguggucaucggccugcuguucaugauccucaccguggccgccaacgagauggggcugcuggagacgaccaagaaggaccucggcaucgggcacguggccgucgagaaccaccaccacgccgcgaugcuggacguggaccugcaccccgccuccgccuggacccucuacgccguggccaccacgaucaucacccccaugaugcggcacaccaucgagaacaccacggcgaacaucagccugaccgccaucgccaaccaggccgcgauccugaugggccucgacaagggcuggcccaucuccaagauggacaucggggucccgcugcuggcccucggcugcuacagccaggugaacccccugacccugaccgccgccgugcucaugcuggucgcccacuacgcgaucaucgggcccggccugcaggccaaggccacgcgcgaggcccagaagcgcaccgccgcggggaucaugaagaaccccaccguggacggcaucguggccaucgaccucgacccggucguguacgacgccaaguucgagaagcagcugggccagaucaugcugcucauccugugcaccucccagauccugcucaugcggacgaccugggcccugugcgagagcaucacccuggccaccgggccccucacgacccugugggagggcucccccgggaaguucuggaacaccaccaucgcggugagcauggccaacaucuuccgcggcagcuaccuggccggcgccgggcucgcguucucccugaugaagucccugggcgggggccggcgcgggacgggcgcccagggcgagacccucggggagaaguggaagcggcagcugaaccagcuguccaagagcgaguucaacaccuacaagcgcuccggcaucauggaggucgaccggagcgaggccaaggaggggcucaagcgcggcgagaccacgaagcacgccgugucccgggggaccgccaagcugcgcugguucguggagcggaaccuggucaagcccgagggcaaggugaucgaccugggcugcgggcgcggcggguggagcuacuacugcgcgggccucaagaaggugaccgaggucaagggguacaccaagggcggcccggggcacgaggagcccauccccauggccacguacggcuggaaccuggugaagcugcacuccgggaaggacguguucuucaucccgcccgagaagugcgacacccuccugugcgacaucggcgagagcucccccaaccccaccaucgaggaggggcggacccugcgcguccucaagaugguggagcccuggcugcggggcaaccaguucugcaucaagauccugaaccccuacaugcccagcguggucgagacgcucgagcagaugcagcgcaagcacggcgggaugcuggugcggaacccccugucccgcaacagcacccacgagauguacuggguguccugcggcaccgggaacaucgucagcgccgugaacaugaccucccggaugcuccugaaccgcuucaccauggcccaccgcaagcccacguacgagcgggacguggaccugggcgccggcacccgccacgucgcgguggagccggagguggccaaccucgacaucaucgggcagcggaucgagaacaucaagcacgagcacaagagcaccuggcacuacgacgaggacaaccccuacaagaccugggccuaccacggcuccuacgaggucaagcccagcgggagcgccuccagcauggugaacggcgucgugaagcugcugacgaagcccugggacgugaucccgauggucacccagaucgccaugaccgacaccacgcccuucgggcagcagcgcguguucaaggagaagguggacacccggacccccaaggcgaagcgcggcaccgcccagaucauggaggucacggccaaguggcucuggggcuuccugucccggaacaagaagccgcgcaucugcacccgggaggaguucacccgcaaggugcggagcaacgccgcgaucggggccguguucgucgacgagaaccaguggaacuccgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggcgaagggcagccgcgccaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacacggcggggugggacacccgcaucaccgaggacgaccuccagaacgaggcccggaucaccgacaucauggagcccgagcacgcccugcuggccaaguccaucuucaagcucacguaccagaacaaggugguccgcgugcagcgccccgccaagaacggcaccgugauggacgucaucagccggcgcgaccagcggggguccggccaggugggcaccuacgggcugaacaccuucacgaacauggaggcgcagcugauccgccagauggagagcgagggcaucuucuccccgagcgagcucgagacccccaaccuggccgagcgggugcuggacuggcucgagaaguacggggucgagcgccugaagcggauggccaucuccggcgacgacugcguggugaagcccaucgacgaccgcuucgccaccgcccugaccgcgcucaacgacauggggaagguccggaaggacaucccccagugggagccgagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgccggguggagccuccgcgagacggccugccugggcaaguccuacgcgcagauguggcagcugauguacuuccaccggcgcgaccuccggcuggccgccaacgccaucugcagcgccguccccguggacuggaucccgaccucccgcaccaccuggagcauccacgcgcaccaccaguggaugacgaccgaggacaugcuguccguguggaaccgggucuggaucgaggagaaccccuggauggaggacaagacccacaucagcuccuggggcgacgugcccuaccucggcaagcgcgaggaccaguggugcggcagccugaucgggcugaccgcccgcgccacgugggccaccaacauccagguggccaucaaccagguccggcgccucaucggcaacgagaacuaccuggacuacaugaccuccaugaagcgguucaagaacgagagcgaccccgagggggcgcugugguga

SEQ ID NO: 8693 - RNA, 9879 nt, Artificial Sequence
  derived and/or modified CDS sequence (opt1) from DENV-1__GU131793__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagaccggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaccacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgccgugcugcggaagcucugcaucgaggcgaagaucuccaacacgaccaccgacagccgcugcccgacccagggcgaggccacgcugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugacgguccacaccggcgaccagcaccagguggggaacgaguccaccgagcacggcaccaccgccacgaucacgccccaggcgcccaccaccgagauccagcucacggacuacggggcccugacccuggacugcagcccccgcaccggccucgacuucaacgagaugguccugcugaccaugaaggagaaguccuggcucgugcacaagcagugguuccuggaccugccccuccccuggacgagcggggccagcaccucccaggagaccuggaaccggcaggaccugcuggugaccuucaagacggcccacgccaagaagcaggaggucguggugcucggcagccaggagggcgcgaugcacaccgcccugaccggggccaccgagauccagacguccggcaccaccaccaucuucgccgggcaccugaagugccgccucaagauggacaagcugacgcugcggggcaugagcuacgucaugugcaccggguccuucaagcucgagaaggagguggccgagacccagcacggcaccgugcugguccagaucaaguacgagggcacggacgcgcccugcaagauccccuucagcacccaggacgagaagggggugacccagaacggccgccugaucaccgccaacccgaucgugacggacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccgccgcauggccauccugggcgacaccgcgugggacuucggguccaucggcggcguguucaccagcgucgggaagcuggugcaccagaucuucggcacggccuacggggugcuguucuccggcgucagcuggaccaugaagaucgggaucggcgugcugcugaccuggcucggccugaacucccggagcaccucccugagcaugacgugcaucgccguggggcucgucacccuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacgcggcuggagaacaucauguggaagcagaucuccaacgagcucaaccacauccugcuggagaacgacaugaaguucaccgugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacacgccggagugccccgacgaccagcgggccuggaacaucugggaggucgaggacuacggcuucgggaucuucaccaccaacaucuggcugaagcugcgcgacagcuacacccaggugugcgaccaccggcucauguccgcggccaucaaggacagcaaggccgugcacgccgacaugggcuacuggaucgaguccgagaagaacgagacguggaagcuggcccgcgcgagcuucaucgaggucaagaccugcaucuggcccaagucccacacccuguggagcaacggcgugcucgaguccgagaugaucauccccaagaucuacgggggcccgaucagccagcacaacuaccggcccggguacuucacccagacggccggccccuggcaccuggggaagcuggagcucgacuucgaccugugcgagggcaccaccguggucguggacgagcacugcggcaaccgcgggccgucccugcggaccacgaccgugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugacgggcacccuggccguguucuuccugcucaucauggggcagcugaccuggaacgaccugauccgccucugcaucauggucggcgccaacgcgagcgaccggauggggaugggcaccacguaccuggcccugauggccaccuucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugacggacuuccagucccaccagcucugggccacccugcugagccucaccuucaucaagaccacguucucccugcacugcgccuggaagaccauggccaugguccugagcaucgugucccucuucccccugugccugagcaccaccucccagaagacgaccuggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugacgauccuccugaaggcgacccugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacacgauguggcacgugacccgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggacguucaagacccccgagggcgaggucggcgccaucgcccuggacuucaagcccgggaccagcggcucccccaucgugaaccgggaggggaagaucgugggccuguacggcaacggggucgugaccacgagcggcaccuacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacgcugauccucgcccccacccgcguggucgccuccgagauggccgaggcgcugaagggcaugcccauccgguaccagaccaccgccgucaagagcgagcacacgggcaaggagaucguggaccugaugugccacgccaccuucaccaugcgccuccugucccccguccgggugccgaacuacaacaugaucaucauggacgaggcccacuucaccgaccccagcuccaucgccgcgcgcggguacaucagcacgcgggugggcaugggggaggccgccgccaucuucaugaccgccacgccgcccggcuccgucgaggcguucccgcagagcaacgccgugauccaggacgaggagcgcgacauccccgagcgguccuggaacagcggguacgaguggaucaccgacuuccccggcaagacggugugguucguccccuccaucaagagcggcaacgacaucgccaacugccugcgcaagaacgggaagcgggugauccagcucucccgcaagaccuucgacaccgaguaccagaagaccaagaacaacgacugggacuacguggucacgaccgacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgggagaaguccgccgccaucgacggggaguaccgccugcggggcgaggcgcgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacgcagcgggcccagaacgcccucgacaaccuggugaugcugcacaacagcgagcagggcgggcgcgccuaccggcacgcgauggaggagcuccccgacaccaucgagacccugaugcugcucgcccugaucgccgugcugaccggcggggucacccucuucuuccuguccggccgcgggcugggcaagacgagcaucggccuccugugcgugauggccuccagcgugcugcucuggauggccuccgucgagccccacuggaucgcggccagcaucauccuggaguucuuccugauggugcuccugauccccgagccggacaagcagcggacgccccaggacaaccagcuggccuacguggucaucgggcuccuguucaugauccugaccguggccgccaacgagaugggccuccuggagaccacgaagaaggaccuggggaucggccacguggcggucgagaaccaccaccacgccgccaugcucgacguggaccugcaccccgccuccgccuggacccuguacgcgguggccaccaccaucaucacgccgaugaugcgccacaccaucgagaacaccaccgccaacaucagccucacggccaucgccaaccaggcggccauccugauggggcuggacaagggcuggcccaucuccaagauggacaucggcgucccccuccuggcccuggggugcuacagccaggugaacccccucacccugaccgccgcggugcugaugcucgucgcccacuacgccaucaucggcccggggcugcaggccaaggccacccgcgaggcgcagaagcggacggccgccggcaucaugaagaaccccaccguggacgggaucguggccaucgaccuggaccccgucguguacgacgccaaguucgagaagcagcucggccagaucaugcugcugauccucugcaccucccagauccugcugaugcgcaccacgugggcgcucugcgagagcaucacccuggccaccggcccccugaccacgcucugggagggguccccgggcaaguucuggaacaccaccaucgccgugagcauggccaacaucuuccggggguccuaccuggccggcgcgggccuggccuucagccucaugaagucccucgggggcgggcgccgggggaccggggcccagggcgagacgcugggcgagaaguggaagcgccagcucaaccagcuguccaagagcgaguucaacaccuacaagcgguccgggaucauggaggucgaccgcagcgaggccaaggagggccugaagcgcggggagaccaccaagcacgcggugucccgcggcacggccaagcuccggugguucguggagcgcaaccuggucaagcccgaggggaaggugaucgaccugggcugcggccgcggcggguggagcuacuacugcgccgggcugaagaaggugaccgaggucaagggguacaccaagggcggccccggccacgaggagcccaucccgauggccaccuacggguggaaccucgugaagcugcacuccggcaaggacguguucuucaucccgcccgagaagugcgacacgcugcucugcgacaucggggagagcucccccaacccgaccaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggacgggcaacaucgucagcgccgugaacaugaccucccgcaugcugcucaaccgcuucaccauggcgcaccggaagcccaccuacgagcgcgacguggaccugggggccggcacgcggcacgucgccguggagcccgagguggccaaccuggacaucaucggccagcgcaucgagaacaucaagcacgagcacaagagcaccuggcacuacgacgaggacaaccccuacaagaccugggccuaccacggguccuacgaggucaagccgagcggcuccgcgagcagcauggugaacggggucgugaagcuccugaccaagcccugggacgugauccccauggucacgcagaucgccaugaccgacaccacccccuucggccagcagcggguguucaaggagaagguggacacgcgcaccccgaaggccaagcgggggaccgcccagaucauggaggucaccgccaaguggcuguggggcuuccucucccgcaacaagaagccccggaucugcacgcgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacgcggaucaccgaggacgaccugcagaacgaggcccgcaucaccgacaucauggagccggagcacgcccuccuggcgaaguccaucuucaagcugaccuaccagaacaaggugguccgcgugcagcggcccgccaagaacgggacggugauggacgucaucagccgccgggaccagcgcggcuccggccaggugggcaccuacggccucaacaccuucaccaacauggaggcccagcugauccggcagauggagagcgaggggaucuucucccccagcgagcuggagacgcccaaccucgccgagcgcgugcuggacuggcuggagaaguacggcgucgagcggcucaagcgcauggccaucuccggggacgacugcguggugaagccgaucgacgaccgguucgcgaccgcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccuggggaagcgcgaggaccaguggugcggcagccucaucggccugaccgcccgggccaccugggcgaccaacauccagguggccaucaaccagguccgccggcugaucgggaacgagaacuaccucgacuacaugacguccaugaagcgcuucaagaacgagagcgaccccgagggcgcccugugguga

SEQ ID NO: 8694 - RNA, 9879 nt, Artificial Sequence
  derived and/or modified CDS sequence (opt1) from DENV-1__GU131794__SS-prME
agcgugaccaugcugcugaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccguggggcuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgugguguccugggaggaggaggccgagcacagcggcgcgucccacaacauccuggucgaggugcaggacgacgggacgaugaagaucaaggacgaggagcgcgacgacacccugaccauccuccugaaggccacccugcucgccgugagcggcgucuacccgcuguccauccccgccacccuguucgugugguacuucuggcagaagaagaagcagcggagcggggugcucugggacacgcccagcccgcccgaggucgagcgcgccgugcuggacgacggcaucuaccggaucaugcagcgcggccugcuggggcggagccaggugggcgucgggguguuccaggagaacguguuccacaccauguggcacgucacccgcggcgcggugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaaccccaagaacguccagacggcccccgggaccuucaagaccuccgagggcgaggugggcgccaucgcgcuggacuucaagcccgggaccagcggcagccccaucgugaaccgggaggggaagaucgucggccuguacggcaacgggguggugacgaccuccggcaccuacgucagcgccaucgcccaggccaaggcgucccaggaggggccccucccggagaucgaggacgagguguuccgcaagcggaaccugaccaucauggaccugcaccccggcagcgggaagacgcgccgguaccuccccgccaucgugcgcgaggccaucaagcggaagcugcgcacccugauccucgccccgacccgcgucguggccuccgagauggcggaggcccugaagggcaugcccauccgguaccagaccacggccgucaagagcgagcacaccggcaaggagaucgucgaccugaugugccacgccaccuucaccaugcgccuccugucccccgugcgggugcccaacuacaacaugaucaucauggacgaggcccacuucacggacccgagcuccaucgcggcccgcggguacaucagcacccgggucggcaugggggaggccgccgccaucuucaugaccgcgacgccgcccggcuccguggaggccuucccccagagcaacgccgugauccaggacgaggagcgcgacaucccggagcgguccuggaacagcggguacgaguggaucacggacuuccccggcaagaccgucugguucgugcccuccaucaagagcggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgcgaacuuccgggccgaccgcgugaucgacccccggcgcugccugaagccggucauccugaaggacgggcccgagcgggugauccucgccggccccaugcccgucaccguggccuccgccgcgcagcgccgggggcgcaucggccggaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccgccugcggggcgaggcccgcaagaccuucguggagcucaugcggcgcggggaccugccggucuggcugagcuacaagguggccuccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccccucgcccugcgcgaguucaaggaguucgcggccggccggcgcagcaucuccggggaccugauccucgagaucggcaagcugccccagcaccugacccagcgggcccagaacgcccucgacaaccuggugaugcugcacaacagcgagcagggcgggcgcgcguaccggcacgccauggaggagcucccggacaccaucgagacccugaugcugcucgcccugaucgccgugcugacgggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagcccgaccggcagcgcaccccgcaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucacccccaugaugcggcacaccaucgagaacaccacggccaacaucagccucaccgccaucgcgaaccaggccgccauccugauggggcuggacaagggcuggccgaucuccaagauggacaucggcgucccccuccuggcccuggggugcuacagccaggugaacccccucacccugaccgcggccgugcugaugcucgucgcccacuacgccaucaucggccccgggcugcaggccaaggcgacgcgcgaggcccagaagcgcaccgccgccggcaucaugaagaacccgaccguggacgggaucguggccaucgaccuggaccccgucguguacgacgcgaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgugagcauggccaacaucuuccgcgggagcuaccuggcgggcgccggccuggccuucucccucaugaagucccucgggggcgggcggcgcgggacgggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagaccacgaagcacgccgugucccggggcaccgccaagcuccgcugguucguggagcggaaccuggucaagccggaggggaaggugaucgaccugggcugcggccgcgggggcuggagcuacuacugcgccgggcugaagaaggugaccgaggucaagggcuacaccaagggcgggcccggccacgaggagcccauccccauggccacguacggguggaaccucgugaagcugcacuccggcaaggacguguucuucaucccgcccgagaagugcgacacccugcucugcgacaucggggagagcucccccaaccccaccaucgaggagggccggacccugcgcguccugaagaugguggagccguggcuccgggggaaccaguucugcaucaagauccugaaccccuacaugcccagcguggucgagacgcuggagcagaugcagcgcaagcacggcggcaugcucgugcggaacccccugucccgcaacagcacccacgagauguacuggguguccugcgggaccggcaacaucgucagcgcggugaacaugaccucccggaugcugcucaaccgcuucaccauggcccaccgcaagccgacguacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacggggucgugaagcuccugacgaagccgugggacgugauccccauggucacccagaucgccaugaccgacaccacgcccuucggccagcagcgcguguucaaggagaagguggacacccggacccccaaggccaagcgcgggaccgcccagaucauggaggucacggcgaaguggcuguggggcuuccucucccggaacaagaagccgcgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagcccgagcacgcgcuccuggccaaguccaucuucaagcugacguaccagaacaaggugguccgggugcagcgcccggccaagaacgggaccgugauggacgucaucagccgccgggaccagcgcggcuccggccaggugggcaccuacggccucaacaccuucacgaacauggaggcccagcugauccggcagauggagagcgaggggaucuucucccccagcgagcuggagacccccaaccucgccggccgcgugcuggacuggcuggagaagcacggggucgagcggcucaagcgcauggcgaucuccggcgacgacugcguggugaagcccaucgacgaccgguucgccaccgcccugaccgcccugaacgacauggggaagguccgcaaggacaucccgcagugggagcccagcaagggcuggaacgacuggcagcagguccccuucugcagccaccacuuccaccagcucaucaugaaggacggccgggagaucgugguccccugccgcaaccaggacgagcugguggggcgggcccgcgugucccagggcgcgggguggagccugcgggagacggccugccucggcaaguccuacgcccagauguggcagcugauguacuuccaccgccgggaccugcgccucgccgcgaacgccaucugcagcgccgucccgguggacugggugcccaccucccggaccaccuggagcauccacgcccaccaccaguggaugacgaccgaggacaugcuguccgucuggaaccgcguguggaucgaggagaaccccuggauggaggacaagacccacaucagcuccuggggcgacgugcccuaccugggcaagcgggaggaccaguggugcggcagccucaucgggcugaccgcccgcgcgacgugggccaccaacauccaggucgccaucaaccaggugcgccggcugcucggcaacgagaacuaccuggacuacaugaccuccaugaagcgcuucaagaacgagagcgacccggagggggcccugugguga

SEQ ID NO: 8695 - RNA, 9879 nt, Artificial Sequence
  derived and/or modified CDS sequence (opt1) from DENV-1__GU131796__SS-prME
agcgugaccaugcugcugaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcguggaggccaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaugacgugcgccaaguucaagugcgucaccaagcucgagggcaagaucgugcaguacgagaaccugaaguacagcgugaucgucaccgugcacaccggcgaccagcaccaggucgggaacgaguccacggagcacggcaccaccgcgaccaucacgccccaggcccccagcacggagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccagcggggccuccaccagccaggagaccuggaaccggaaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggcggagacccagcacggcacgguccucgugcagaucaaguacgagggcaccgacgcccccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcgucuucacguccguggggaagcuggugcaccagaucuucggcaccgccuacgggguccuguucagcggcguguccuggaccaugaagaucgggaucggcgugcuccugaccuggcugggccucaacagccgcuccacgagccuguccaugaccugcaucgccgucgggcuggugacccucuaccugggcgugaugguccaggccgacagcgggugcgugaucaacuggaagggccgggagcugaagugcgggagcggcaucuucgugaccaacgagguccacacguggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaagcugaccguggucgugggggacguggcgggcauccucgcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcugaagcugcgggacuccuacacccaggugugcgaccaccgccucaugagcgccgccaucaaggacuccaaggccguccacgccgacaugggcuacuggaucgagagcgagaagaacgagaccuggaagcuggcgcgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccgucgugguggacgagcacugcggcaaccgggggccgagccugcgcacgaccaccgucaccggcaagaucauccacgaguggugcugccgguccugcacgcugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugaccuggaacgaccugauccggcucugcaucauggugggcgcgaacgccuccgaccgcauggggaugggcacgaccuaccuggcccugauggccaccuucaagaugcgcccgauguucgccgugggccuccuguuccggcgccugaccagccgggagguccuccugcugacgaucgggcucucccugguggcgagcgucgagcugcccaacucccucgaggagcugggcgacgggcuggccaugggcaucaugauccucaagcugcugaccgacuuccagagccaccagcucugggccacccugcugucccucaccuucaucaagacgaccagcucccugcacuacgccuggaagaccauggcgauggugcugagcaucgugucccucuucccccugugccugagcaccacgucccagaagaccaccuggcuccccguccugcugggcagccucgggugcaagccgcugaccauguuccugaucgccgagaacaagaucuggggccgcaagagcuggccccucaacgaggggaucauggccgugggcaucguguccauccugcugagcgcccuccugaagaacgacgucccccuggccgggccccucaucgcgggcggcaugcugaucgccugcuacgugaucuccgggagcuccgccgaccugagccucgagaaggccgccgagguguccugggaggaggaggcggagcacagcggcgccucccacaacauccuggucgaggugcaggacgacgggacgaugaagaucaaggacgaggagcgggacgacacccugaccauccuccugaaggccacccugcucgccgugagcggcgucuacccgcuguccauccccgccacccuguucgugugguacuucuggcagaagaagaagcagcgcagcggggugcucugggacacgcccagcccgcccgaggucgagcgggcggugcuggacgacggcaucuaccgcaucaugcagcggggccugcuggggcgcagccaggugggcgucgggguguuccaggagaacguguuccacaccauguggcacgucacccggggcgccgugcucauguaccaggggaagcgccuggagcccuccugggccagcgugaagaaggaccugaucuccuacggcggcggguggcggcuccagggcagcuggaacaccggggaggagguccaggugaucgccguggagcccggcaagaaccccaagaacguccagacggcccccgggaccuucaagaccuccgagggcgaggugggcgcgaucgcccuggacuucaagcccgggaccagcggcagccccaucgugaaccgcgaggggaagaucgucggccuguacggcaacgggguggugacgaccuccggcaccuacgucagcgccaucgcccaggcgaaggccucccaggaggggccccucccggagaucgaggacgagguguuccggaagcgcaaccugaccaucauggaccugcaccccggcagcgggaagacgcggcgcuaccuccccgccaucgugcgggaggccaucaagcgcaagcugcggacccugauccucgccccgacccgcgucguggcguccgagauggccgaggcccugaagggcaugcccauccgcuaccagaccacggccgucaagagcgagcacaccggcaaggagaucgucgaccugaugugccacgccaccuucaccaugcggcuccugucccccgugcgcgugcccaacuacaacaugaucaucauggacgaggcgcacuucacggacccgagcuccaucgccgcccggggguacaucagcacccgcgucggcaugggggaggccgccgcgaucuucaugaccgccacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgcgaacugccugcggaagaacgggaagcgcgugauccagcucucccggaagaccuucgacaccgaguaccagaagacgaagaacaacgacugggacuacgucgugaccaccgacaucagcgagaugggcgccaacuuccgcgccgaccgggugaucgacccccgccggugccugaagccggucauccugaaggacgggcccgagcgcgugauccucgccggccccaugcccgucaccguggccuccgcggcccagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgcggccaucgacggggaguaccgccugcgcggcgaggcccggaagaccuucguggagcucaugcgccgcggggaccugccggucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcacguacuccgacccccucgcgcugcgggaguucaaggaguucgccgccggccgccggagcguguccggggaccugauccucgagaucggcaagcugccccagcaccugacccagcgcgcccagaacgcgcucgacaaccuggugaugcugcacaacagcgagcagggcgggcgggccuaccgccacgccauggaggagcucccggacaccaucgagacccugaugcugcucgcccugaucgccguccugacgggcggggugacccucuucuuccuguccggccgggggcugggcaagaccagcaucggccuccugugcgugauggcguccagcguccugcucuggauggccuccguggagccccacuggaucgccgccagcaucauccuggaguucuuccugauggugcuccugauccccgagcccgaccgccagcggaccccgcaggacaaccagcuggccuacgucgugaucgggcuccuguucaugauccugaccguggcggccaacgagaugggccuccuggagacgaccaagaaggaccuggggaucggccacgucgccguggagaaccaccaccacgccgccaugcucgacguggaccugcaccccgcguccgccuggacccuguacgccgucgccaccacgaucaucacccccaugaugcgccacaccaucgagaacaccacggccaacaucagccucaccgcgaucgccaaccaggccgccauccugauggggcuggacaagggcuggccgaucuccaagauggacaucggcgugccccuccuggcgcuggggugcuacagccaggugaacccccucacccugaccgccgccguccugaugcucguggcccacuacgccaucaucggccccgggcugcaggcgaaggccacgcgggaggcccagaagcgcaccgccgccggcaucaugaagaacccgaccguggacgggaucgucgcgaucgaccuggaccccgugguguacgacgccaaguucgagaagcagcucggccagaucaugcugcugauccucugcaccucccagauccugcugaugcgcacgaccugggcccucugcgagagcaucacccuggccaccggcccccugacgacccucugggaggggucccccggcaaguucuggaacaccaccaucgccgucagcauggcgaacaucuuccgggggagcuaccuggccggcgccggccuggccuucucccucaugaagucccucgggggcgggcgccgggggacgggggcgcagggcgagacccugggcgagaaguggaagcgccagcucaaccagcuguccaagagcgaguucaacaccuacaagcgguccgggaucauggagguggaccgcagcgaggccaaggagggccugaagcgcggggagaccacgaagcacgccgugucccgcggcaccgccaagcuccggugguucgucgagcgcaaccuggugaagccggaggggaaggugaucgaccugggcugcggccgcggcggguggagcuacuacugcgccgggcugaagaaggucaccgaggugaagggguacaccaagggcgggcccggccacgaggagcccauccccauggcgacguacggguggaaccucgugaagcugcacuccggcaaggacgucuucuucaucccgcccgagaagugcgacacccugcucugcgacaucggggagagcucccccaaccccaccaucgaggagggccgcacccugcgggugcugaagaugguggagccguggcuccgcgggaaccaguucugcaucaagauccugaaccccuacaugcccagcgucguggagacgcuggagcagaugcagcggaagcacggcggcaugcucgugcgcaacccccugucccggaacagcacccacgagauguacugggucuccugcgggaccggcaacaucgugagcgccgugaacaugaccucccgcaugcugcucaaccgguucaccauggcccaccgcaagccgacguacgagcgcgacgucgaccugggggccggcacccggcacguggccguggagcccgaggucgcgaaccuggacaucaucggccagcgcaucgagaacaucaagcacgagcacaagagcaccuggcacuacgacgaggacaaccccuacaagaccugggccuaccacggguccuacgaggugaagcccagcggcagcgccuccagcauggucaacgggguggugaagcuccugacgaagccgugggacgucauccccauggugacccagaucgccaugaccgacaccacgcccuucggccagcagcggguguucaaggagaaggucgacacccgcacccccaaggccaagcgggggaccgcgcagaucauggaggugacggccaaguggcuguggggcuuccucucccgcaacaagaagccgcggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacacggccggcugggacacccggaucaccgaggacgaccugcagaacgaggcgaagaucaccgacaucauggagcccgagcacgcccuccuggccaaguccaucuucaagcugacguaccagaacaaggucgugcgcgugcagcggccggccaagaacgggaccgucauggacgugaucagccgccgcgaccagcggggcuccggccaggugggcaccuacggccucaacaccuucacgaacauggaggcccagcugauccgccagauggagagcgaggggaucuucucccccagcgagcuggagacccccaaccucgcgggccggguccuggacuggcuggagaagcacgggguggagcgccucaagcggauggccaucuccggcgacgacugcguggucaagcccaucgacgaccgcuucgccgccgcccugaccgcgcugaacgacauggggaaggugcggaaggacaucccgcagugggagcccagcaagggcuggaacgacuggcagcagguccccuucugcagccaccacuuccaccagcucaucaugaaggacggccgcgagaucgucgugcccugccggaaccaggacgagcugguggggcgcgcccgggucucccagggcgccggguggagccugcgcgagaccgccugccucggcaaguccuacgcgcagauguggcagcugauguacuuccaccggcgcgaccugcggcucgccgccaacgccaucugcagcgccgugccgguggacuggguccccacgucccgcaccaccuggagcauccacgcgcaccaccaguggaugaccacggaggacaugcuguccguguggaaccggguguggaucgaggagaaccccuggauggaggacaagacccacaucagcuccuggggcgacguccccuaccugggcaagcgcgaggaccaguggugcggcagccucaucgggcugaccgcccgggccaccugggccacgaacauccagguggccaucaaccaggugcgccgccugaucggcaacgagaacuaccucgacuacaugaccuccaugaagcgguucaagaacgagagcgacccggagggggcgcugugguga

SEQ ID NO: 8696 - RNA, 9879 nt, Artificial Sequence
  derived and/or modified CDS sequence (opt1) from DENV-1__GU131797__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugcggggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucauggggcagcugaccuggaacgaccugauccgccucugcaucauggucggcgccaacgcgagcgaccggauggggaugggcaccaccuaccuggcccugauggccacguucaagaugcgcccgauguucgccgugggccuccuguuccggcgccugaccucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacugcgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccgccgguccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgcgacgacacccugaccauccuccugaaggcgacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgccguccucauguaccaggggaagcggcuggagcccagcugggcguccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccuguacggcaacggggucgugaccaccagcggcacguacgugagcgcgaucgcccaggccaaggccucccaggaggggccgcuccccgagaucgaggacgaggucuuccgcaagcggaaccugaccaucauggaccugcaccccggcagcgggaagacccgccgguaccucccggcgaucgugcgcgaggccaucaagcgcaagcugcggacccugauccucgcccccacgcgcguggucgccuccgagauggccgaggcgcugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugacggccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccgcggcgcugccugaagcccgugauccugaaggacgggcccgagcgggucauccucgccggccccaugccggugaccgucgccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcgucuccggggaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggccuccgucgagccccacuggaucgcggccagcaucauccuggaguucuuccugauggugcuccugauccccgagccggacaagcagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcggcggguggagcuacuacugcgccgggcugaagaaggugacggaggucaagggguacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagcgcgacguggaccugggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacgggaccgugauggacgucaucagccgccgggaccagcgcggcuccggccaggugggcacguacggccucaacaccuucaccaacauggaggcccagcugauccggcagauggagagcgaggggaucuucucccccagcgagcuggagacccccaaccucgccgagcgcgugcuggacuggcuggagaaguacggcgucgagcggcucaagcgcauggccaucuccggggacgacugcguggugaagccgaucgacgaccgguucgcgacggcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgcgaggaccaguggugcggcagccucaucggccugaccgcccgggccaccugggcgaccaacauccagguggccaucaaccagguccgccggcugaucgggaacgagaacuaccucgacuacaugaccuccaugaagcgcuucaagaacgagagcgaccccgagggcgcccugugguga

SEQ ID NO: 8697 - RNA, 9879 nt, Artificial Sequence
  derived and/or modified CDS sequence (opt1) from DENV-1__GU131801__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucggcaucggcgcgggggagaaggcccucaagcugagcugggugaagaagggcuccagcaucgggaagaugguggaggccaccgcccgcggcgcccggcgcauggcgauccugggggacacggccugggacuucggcuccaucggcggggucuucaccagcgugggcaagcucgugcaccagaucuucgggaccgccuacggcguccuguucuccggggugagcuggaccaugaagaucggcaucggcgugcugcucacguggcuggggcugaacucccgcagcaccucccucagcaugaccugcaucgccgucggccuggugacccuguaccucggggugaugguccaggccgacuccggcugcgugaucaacuggaaggggcgggagcugaagugcggcagcggcaucuucgugacgaacgagguccacaccuggaccgagcaguacaaguuccaggcggacagcccgaagcgccuguccgccgccaucgggaaggccugggaggagggcgugugcgggauccggagcgccacccgccucgagaacaucauguggaagcagaucuccaacgagcugaaccacauccugcucgagaacgacaugaaguucaccguggucgugggcgacguggcggggauccugguccagggcaagaagaugauccggccccagcccauggaguacaaguacagcuggaaguccuggggcaaggccaagaucaucggggccgacgugcagaacagcacguucaucaucgacggccccaacaccccggagugccccgacgaccagcgcgccuggaacaucugggagguggaggacuacggguucggcaucuucaccaccaacaucuggcugaagcuccgggacuccuacacgcaggucugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcaucuggcccaagagccacacccucugguccaacgggguccuggagagcgagaugaucauccccaagauccacggcgggccgaucucccagcacaacuaccgccccggcuacuucacgcagaccgccgggcccuggcaccugggcaagcucgagcuggacuucgaccugugcgagggcaccaccgugguggucgacgagcacugcgggaaccggggcccgagccuccgcacgaccaccgugaccgggaagaucauccacgaguggugcugccgguccugcacgcugccgccccugcgcuuccggggcgaggacgggugcugguacggcauggagauccgccccgugaaggagaaggaggagaaccucgucaagagcauggugagcgccggcuccggggagguggacagcuucucccugggccugcucugcaucagcaucaugaucgaggaggucaugcggucccgcuggagccggaagaugcugaugaccgggacccuggccguguucuuccuccugaucaugggccagcugaccuggaacgaccucauccgccugugcaucauggugggggccaacgcguccgaccgcaugggcaugggcacgaccuaccuggcccucauggccaccuucaagaugcggccgauguucgccgucgggcugcuguuccgccggcucaccagccgcgaggugcugcugcucacgaucggccugucccuggucgccagcguggagcuccccaacucccuggaggagcugggggacggccucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgucagccuguucccccugugccucuccaccacgagccagaagaccaccuggcugcccgugcugcucgggucccugggcugcaagccgcugaccauguuccucaucgcggagaacaagaucugggggcggaaguccuggccccugaacgagggcaucauggccguggggaucgucagcauccugcucuccagccugcugaagaacgacgugccccucgccggcccccugaucgccggcgggaugcugaucgccugcuacgugaucuccggcagcuccgcggaccucagccuggagaaggccgccgaggucuccugggaggaggaggccgagcacagcggggccucccacaacauccugguggaggugcaggacgacggcacgaugaagaucaaggacgaggagcgcgacgacacccucaccauccugcugaaggcgacccuccuggccgucagcgggguguacccgcuguccauccccgccacccucuucguguggcacuucuggcagaagaagaagcagcggagcggcguccugugggacacgcccagcccgcccgagguggagcgcgccgugcuggacgacggcaucuaccggaucaugcagcgcgggcugcucggccggagccaggucggggugggcguguuccaggagaacgucuuccacaccauguggcacgugacccgcggggccgugcugauguaccagggcaagcggcuggagcccuccugggcgagcgucaagaaggaccucaucuccuacggcgggggcuggcgcuuccaggggagcuggaacaccggcgaggagguccaggugaucgccgucgagcccgggaagaaccccaagaacgugcagacggcccccggcaccuucaagacccccgagggcgaggugggggccaucgcccuggacuucaagcccggcaccuccgggagccccaucgucaaccgggagggcaagaucgugggccuguacgggaacggcguggucacgaccagcgggaccuacguguccgcgaucgcccaggccaaggccagccaggagggcccgcuccccgagaucgaggacgagguguuccgcaagcggaaccugaccaucauggaccugcaccccggguccggcaagacgcgccgguaccucccggcgaucguccgcgaggccaucaagcggaagcugcgcacccugauccucgcccccacccgcgugguggccagcgagauggccgaggcgcugaagggcaugcccauccgguaccagaccacggccgucaaguccgagcacaccgggaaggagaucguggaccugaugugccacgccaccuucaccaugcgccuccugagccccgugcgggucccgaacuacaacaugaucaucauggacgaggcccacuucacggaccccuccagcaucgccgcgcgcggcuacaucuccacccggguggggaugggcgaggccgccgccaucuucaugaccgccacgccgcccgggagcauggaggcguucccgcaguccaacgccgugauccaggacgaggagcgcgacauccccgagcggagcuggaacuccggcuacgaguggaucacggacuuccccggcaagaccgucugguucgugcccagcaucaaggccgggaacgacaucgccaacugccugcgcaagaacggcaagcgggugauccagcucucccgcaagaccuucgacaccgaguaccagaagacgaagaacaacgacugggacuacgucgugaccaccgacaucagcgagaugggggcgaacuuccgggccgaccgcgugaucgacccgcggcgcugccugaagcccgucauccugaaggacggccccgagcgggugauccucgccgggcccaugccggucaccguggccuccgccgcgcagcgccggggccgcaucggccggaaccacaacaaggagggggaccaguacaucuacaugggccagccccugaacaacgacgaggaccacgcccacuggacggaggccaagaugcugcucgacaacaucaacacccccgaggggaucauccccgcccuguucgagccggagcgcgagaaguccgccgcgaucgacggcgaguaccgccugcgcggggaggcccgcaagaccuucguggagcucaugcggcgcggcgaccugcccgucuggcuguccuacaagguggccagcgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggacguacuccgacccccucgcccugcgcgaguucaaggaguucgcggccgggcggcgcagcguguccggcgaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacccugaugcugcucgcccugaucgccguccugaccggcggggugacccucuucuuccuguccgggaaggggcugggcaagaccagcaucgggcuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucggccuccuguucaugauccugaccguggccgcgaacgagauggggcuccuggagacgaccaagaaggaccugggcaucgggcacgucgccguggagaaccaccaccacgccgccaugcucgacguggaccugcaccccgccuccgcguggacccuguacgccgucgccaccacgaucaucaccccgaugaugcgccacaccaucgagaacaccacggccaacaucagccucaccgccaucgcgaaccaggccgccauccugaugggccuggacaagggcuggcccaucuccaagauggacaucggggugccccuccuggcccugggcugcuacagccaggugaacccccucacccugaccgcggccguccugaugcucguggcccacuacgccaucaucgggccgggccugcaggccaaggcgacgcgggaggcccagaagcgcaccgccgccgggaucaugaagaaccccaccaucgacggcaucguggccaucgaccuggaccccgucguguacgacgcgaaguucgagaagcagcucggccagaucaugcugcugauccucugcaccucccagauccugcugaugcgcacgaccugggcccucugcgagagcaucacccuggccaccgggccccugacgacccucugggagggcuccccggggaaguucuggaacaccaccaucgccgugagcauggccaacaucuuccggggcuccuaccuggcgggcgccgggcuggccuucagccucaugaagucccugggcgggggccgccgggggacgggcgcccagggcgagacccugggggagaaguggaagcgccagcucaaccagcuguccaagagcgaguucaacaccuacaagcgguccggcaucauggaggucgaccgcagcgaggcgaaggaggggcugaagcggggcgagaccacgaagcacgccgugucccgcgggaccgccaagcuccggugguucguggagcgcaaccuggucaagcccgagggcaaggugaucgaccugggcugcgggcggggcggguggagcuacuacugcgccggccugaagaaggugaccgaggucaagggguacaccaagggcggccccgggcacgaggagcccaucccgauggccacguacggcuggaaccucgugaagcugcacuccgggaaggacguguucuucaucccgcccgagaagugcgacacccugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacgcuggagcagaugcagcggaagcacggcgggaugcucgugcgcaacccgcugucccggaacagcacccacgagauguacuggguguccugcggcaccgggaacaucgucagcgcggugaacaugaccucccgcaugcugcucaaccgguucaccauggcccaccgcaagcccacguacgagcgcgacguggaccugggcgccggcacccggcacgucgccguggagcccgagguggccaaccuggacaucaucgggcagcgcaucgagaacaucaagcacgagcacaagagcaccuggcacuacgacgaggacaaccccuacaagaccugggcguaccacggcuccuacgaggucaagccgagcggguccgccagcagcauggugaacggcgucgugaagcuccugacgaagcccugggacgugauccccauggucacccagaucgccaugaccgacaccacgcccuucgggcagcagcggguguucaaggagaagguggacacccgcaccccgaaggccaagcggggcaccgcccagaucauggaggucacggcgcgcuggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgaccgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacacggccgggugggacacccgcaucaccgaggacgaccugcagaacgaggccaagaucaccgacaucauggagccggagcacgcgcuccuggccaaguccaucuucaagcugacguaccagaacaaggugguccgggugcagcgccccgccaagaacggcaccgugauggacgucaucagccgccgggaccagcgcggguccggccaggugggcaccuacgggcucaacaccuucacgaacauggaggcccagcugauccggcagauggagagcgagggcaucuuccugcccaacgagcucgagacccccaaccuggccgggcgcgugcuggacuggcucgagaaguacggcgucgagcggcugaagcgcauggcgaucuccggggacgacugcguggugaagccgaucgacgaccgguucgccaccgcccugaccgcccucaacgacaugggcaagguccgcaaggacaucccccagugggagcccagcaagggcuggaacgacuggcagcagguccccuucugcucccaccacuuccaccagcugaucaugaaggacgggcgggagaucguggucccgugccgcaaccaggacgagcuggugggccgggcccgcgugagccagggggcgggcuggucccuccgggagacggccugccugggcaagagcuacgcccagauguggcagcugauguacuuccaccgccgggaccuccgccuggccgcgaacgccaucugcagcgccguccccguggacugggugcccaccucccggaccaccuggagcauccacgcccaccaccaguggaugacgaccgaggacaugcuguccgucuggaaccgcguguggaucgaggagaaccccuggauggaggacaagacccggaucagcuccugggaggacgugccguaccucggcaagcgcgaggaccaguggugcggcagccugaucgggcugaccgcccgcgcgacgugggccaccaacauccaggucgccaucaaccaggugcggcgccucaucggcaacgagaacuacuccgacuacaugaccagcaugaagcgguucaagaacgaguccgagcccgagggggcccugugguga

SEQ ID NO: 8698 - RNA, 9879 nt, Artificial Sequence
  derived and/or modified CDS sequence (opt1) from DENV-1__GU131804__SS-prME
agcgugaccauguuccugaugcucaugcccaccgcccuggccuuccaccugaccacccggggcggggagccccacaugaucgugagcaagcaggagcggggcaagagccuccuguucaagaccagcgccggggugaacaugugcacccugaucgccauggaccucggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccuggcgccccacgugggccucgggcuggagacccgcaccgagaccuggaugagcuccgagggcgccuggaagcagauccagcgggucgagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggcccgggccucccaggaggggccgcuccccgagaucgaggacgagguguuccgcaagcggaaccugaccaucauggaccugcaccccggcagcgggaagacccgccgguaccucccggcgaucguccgcgaggccaucaagcgcaagcugcggacccugauccucgcccccacgcgcgugguggccuccgagauggccgaggcgcugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggugauccucgccggccccaugccggucaccguggccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcguguccggggaccugauccucgagaucggcaagcugccgcagcaccugacccagcgggcccagaacgcccucgacaaccuggucaugcugcacaacagcgagcagggcgggcgcgccuaccggcacgcgauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggccuccguggagccccacuggaucgcggccagcaucauccuggaguucuuccugaugguccuccugauccccgagccggaccggcagcgcacgccccaggacaaccagcuggccuacguggugaucgggcuccuguucaugauccugaccgucgccgccaacgagaugggccuccuggagaccaccaagaaggaccuggggaucggccacgcggccguggagaaccaccaccacgccgccaugcucgacguggaccugcaccccgccuccgcguggacgcuguacgccgucgccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggugaacccccucacgcugaccgcggccguccugaugcucguggcccacuacgccaucaucggcccggggcugcaggccaaggcgacccgggaggcccagaagcgcaccgccgccggcaucaugaagaaccccacgguggacgggaucgucgccaucgaccuggaccccgugguguacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgucagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggcgaaggagggccugaagcgcggggagaccaccaagcacgccgugucccggggcaccgccaagcuccgcugguucgucgagcggaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccggacccugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgcggugaacaugacgucccgcaugcugcucaaccgguucaccauggcccaccgcaagcccaccuacgagcgggacgucgaccugggggccggcacccgccacguggccguggagcccgaggucgccaacaucgacaucaucggccagcggaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcucaccaagcccugggacgucauccccauggugacccagaucgccaugacggacaccacccccuucggccagcagcgcguguucaaggagaaggucgacacccggacgccgaaggccaagcgcgggaccgcccagaucauggaggugaccgcgaaguggcuguggggcuuccugucccggaacaagaagccccgcaucugcacccgggaggaguucacgcgcaaggugcggagcaacgccgccaucggcgccgucuucguggacgagaaccaguggaacuccgcgaaggaggccguggaggacgagcgcuucugggaccucguccaccgggagcgcgagcugcacaagcaggggaagugcgcgaccugcguguacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucacggaggacgaccugcagaacgaggcccgcaucaccgacaucauggagccggagcacgcgcugcucgccaaguccaucuucaagcugaccuaccagaacaaggucgugcgggugcagcgccccgccaagaacgggaccgucauggacgugaucagccggcgcgaccagcggggcuccggccagguggggacguacggccugaacaccuucaccaacauggaggcccagcucauccgccagauggagagcgaggggaucuucucccccagcgagcuggagacccccaaccuggccgagcggguccucgacuggcuggagaaguacggcguggagcgccugaagcggauggcgaucuccggggacgacugcguggucaagccgaucgacgaccgcuucgccacggcccucaccgcccugaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcucgugggccgcgcccgggucagccagggggcgggcuggagccugcgcgagaccgccugccuggggaaguccuacgcccagauguggcagcucauguacuuccaccggcgcgaccugcggcuggccgcgaacgccaucugcagcgccgugcccguggacuggauccccaccucccgcacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccuggggaagcgggaggaccaguggugcggcagccugaucggccucaccgcccgcgcgaccugggccaccaacauccaggucgccaucaaccaggugcggcgccugaucgggaacgagaacuaccuggacuacaugaccuccaugaagcgguucaagaacgagagcgaccccgagggcgcccucugguga

SEQ ID NO: 8699 - RNA, 9879 nt, Artificial Sequence
  derived and/or modified CDS sequence (opt1) from DENV-1__GU131805__SS-prME
agcgugaccaugcugcucaugcugaugcccaccgcccuggccuuccaccucaccacccgcggcggggagccccacaugaucgugagcaagcaggagcggggcaagagccugcuguucaagaccuccgcgggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaugacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagccccgagauccagcugcccgacuacggggcccucacgcuggacugcagcccccggcccggccuggacuucaacgagaugguccuccugcccaugaaggagaaguccuggcuggugcacaagcagugguuccucgaccugccgcugcccuggaccagcggggccuccaccagccaggagaccuggaaccggaaggaccuccugggcacguucaagaccgcccacgcgaaggagcaggagguggucgugcugggcucccaggagggggccaugcacaccgcccucaccggcgccacggagauccagaccagcgggaccaccacgaucuucgccggccaccugaagugccgccugaagauggacaagcucacccugaaggggauguccuacgugaugugcaccggcagcuucaagcuggagaaggaggucgcggagacccagcacggcacggugcucgugcagaucaaguacgaggggaccgacgcccccugcaagauccccuucuccacccaggacgagaagggcgucacccagaacgggcggcugaucacggccaacccgaucgugaccgacaaggagaagcccgugaacaucgaggccgagcccgcguucggcgagagcuacaucgucaucggcgccggggagaaggcccugaagcuguccugggugaagaagggcagcuccaucgggaagauguucgaggccaccgcccgcggcgcgcggcgcauggccauccucggggacaccgccugggacuucggcagcaucggcgggguguucacguccgucggcaagcuggugcaccagaucuucgggaccgccuacggcgugcuguucagcggggucuccuggaccaugaagaucggcaucggcgugcuccugaccuggcuggggcucaacagccgcuccacgagccuguccaugaccugcaucgccgugggccuggucacccucuaccugggggugauggugcaggcggacagcggcugcgucaucaacuggaaggggcgggagcugaagugcggcagcggcaucuucgggaccaacgaggugcacacguggaccgagcaguacaaguuccaggccgacucccccaagcgccucagcgccgccaucggcaaggccugggaggagggggugugcggcauccgguccgcgacccgccuggagaacaucauguggaagcagaucagcaacgagcugaaccacauccuccuggagaacgccaugaagcugaccgucguggugggggacgucgccggcauccucgcccagggcaagaagaugauccggccgcagcccauggaguacaaguacuccuggaaguccugggggaaggcgaagaucaucggcgccgacgugcagaacacgaccuucaucaucgacgggcccaacacccccgagugcccggacgaccagcgcgccuggaacaucugggagguggaggacuacggcuucggcaucuucaccaccaacaucuggcugaagcugcgggacuccuacacgcaggucugcgaccaccgccucaugagcgccgccaucaaggacuccaaggcggugcacgccgacaugggguacuggaucgagagcgagaagaacgagcccuggaagcuggcccgggccuccuucaucgaggugaagaccugcaucuggcccaagagccacacccugugguccaacggcguccucgagagcgagaugaucaucccgaagaucuacgggggccccaucucccagcacaacuaccgccccggguacuucacccagacggccggccccuggcaccugggcaagcuggagcucgacuucgaccugugcgaggggaccaccgugguggucgacgagcacugcggcaaccgggggccgagccugcgcaccacgaccgugcccggcaagaucauccacgaguggugcugccgguccugcacccugccgccccuccgcuucaagggggaggacggcugcugguacggcauggagaucagcccggugaaggagaaggaggagaaccuggucaagagcaugguguccgcggggagcggcgagguggacuccuucagccucgggcugcugugcaucuccaucaugaucgaggaggucaugcggagccgcuggucccggaagaugcucaugaccggcccccugcccguguucuuccugcucaucauggggcagcugcccuggaacgaccugauccgccucugcaucauggugggcgccaacgccagcgaccggaugggcauggggacgccguaccuggcccugauggccaccuucaagaugcgccccauguucgcggucggccuccuguuccgccggcugaccucccgcgaggggcuccugcugaccaucggccucagccugguggccuccguggagcugcccaacagccucgaggagcugggcgacgggcuggccaugggcaucaugauccucaagcugcugacggacuuccagucccaccagcucugggccacccugcuggcgcucaccuucaucaagaccacguucagccuggacuacgccuggaagaccauggccaugguccuguccaucgugagccucuucccccugugccuguccaccaccagccagaagacgaccuggcucccgguccugcuggggucccucggcugcaagccccugaccauguuccugaucgccgagaacaagaucugggggcgcaagagcuggccccucaacgagggcaucauggccgugggcaucgugagcauccugcuguccgcgcuccugaagaacgacgucccccuggccgggccgcucaucgccggcgggaugcugaucgccugcuacgugaucagcggcuccagcgccgaccugucccucgagaaggcggccgaggugagcugggaggaggaggccgagcacuccgggggcagccacaacauccuggucgaggugcaggacgacggcaccaugaagaucaaggacgaggagcgcgacgccacgcugaccauccuccugaaggccacccugcucgcgguguccggggucuacccccugagcauccccgccacccuguucgugugguacuucuggcagaagaagaagcagcgguccggcgugcucugggacacgcccagcccgcccgaggucgagcgcgccgugcuggacgacgggaucuaccggaucaugcagcgcggccugcuggggcggucccaggugggcgucggcguguuccaggagaacguguuccacaccauguggcacgucacccgcggggccgugcucauguaccagggcaagcggcuggagcccagcugggccuccgugaagaaggaccugaucagcuacgggggcggguggcgccuccagggcuccuggaacaccggcgaggagguccaggugaucgcgguggagccggggaagaaccccaagaacguccagacggcccccggcaccuucaagaccagcgagggggaggugggcgccaucgcccuggacuucaagcccggcaccuccgggagcccgaucgugaaccgggagggcaagaucgucgggcuguacggcaacgggguggugaccacgagcggcaccuacgucuccgcgaucgcccaggccaaggccagccaggagggcccccuccccgagaucgaggacgagguguuccgcaagcggaaccugaccaucauggaccugcaccccggguccggcaagacccgccgguaccucccggccaucgugcgcgaggcgaucaagcggaagcugcgcacgcugauccucgcccccacccgggucguggccagcgagauggccgaggcccugaaggggaugcccauccgcuaccagaccaccgcggugaaguccgagcacacgggcaaggagaucgucgaccugaugugccacgccaccuucaccaugcgccuccugagccccgugcgggugccgaacuacaacaugaucaucauggacgaggcccacuucaccgaccccuccagcaucgccgcccgcggguacaucuccacgcgggucggcaugggcgaggcggccgccaucuucaugaccgccacgccgcccgggagcguggaggcguucccgcaguccaacgccgugauccaggacgaggagcgcgacauccccgagcggagcuggaacuccggcuacgaguggaucaccgacuuccccgggaagacggucugguucgugcccagcaucaaguccggcaacgacaucgccaacugccugcgcaagaacgggaagcgggugauccagcucagccgcaagaccuucgacaccgaguaccagaagaccaagaacaacgacugggacuacgucgugacgaccgacaucuccgagaugggcgccaacuuccgggccgaccgcgugaucgacccgcggcgcugccugaagcccgucauccugaaggacggccccgagcgggugauccucgcggggcccaugccggugaccgucgccagcgccgcccagcgccggggccgcaucgggcggaaccacaacaaggagggcgaccaguacaucuacauggggcagccccugaacaacgacgaggaccacgcccacuggaccgaggcgaagaugcugcucgacaacaucaacacgcccgagggcaucauccccgcccuguucgagccggagcgcgagaaguccgccgccaucgacggcgaguaccggcugcgcggggaggcccgcaagaccuucguggagcucaugcggcgcggcgaccugcccgucuggcugagcuacaagguggcgagcgagggguuccaguacuccgaccggcgcuggugcuucgacggcgagcggaacaaccaggugcucgaggagaacauggacgucgagaucuggaccaaggagggcgagcgcaagaagcugcggccccgcuggcuggacgcccggaccuacagcgacccgcucgcccugcgcgaguucaaggaguucgccgcggggcggcgcuccgugagcggcgaccugauccucgagaucgggaagcugccccagcaccugacgcagcgggcccagaacgcccucgacaaccuggugaugcugcacaacuccgagcagggcgggcgcgccuaccggcacgccauggaggagcuccccgacaccaucgagacccugaugcugcucgcgcugaucgccguccugaccggcggcgugacccuguucuuccugagcgggcgcggccuggggaagaccuccaucggccuccugugcgugauggccagcuccguccugcucuggauggccagcguggagccccacuggaucgccgcguccaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagacgaccaagaaggaccugggcaucgggcacgucgccguggagaaccaccaccacgcggccaugcucgacguggaccugcaccccgccagcgccuggacccuguacgccgucgcgaccacgaucaucaccccgaugaugcggcacaccaucgagaacaccaccgccaacaucucccucacggccaucgccaaccaggcggccauccugaugggccuggacaagggguggcccaucagcaagauggacaucggcgugccccuccuggcccuggggugcuacucccaggugaacccccucacccugaccgccgccguccugaugcucguggcgcacuacgccaucaucggcccgggccugcaggccaaggccacccgcgaggcccagaagcggacggcggccgggaucaugaagaaccccaccguggacggcaucgucgccaucgaccuggaccccgugguguacgacgccaaguucgagaagcagcucgggcagaucaugcugcugauccucugcaccagccagauccugcugaugcgcaccacgugggcccucugcgaguccaucacccuggcgaccggcccccugaccacgcucugggagggcagcccggggaaguucuggaacaccaccaucgccgucuccauggccaacaucuuccgcggcagcuaccuggccggggcgggccuggccuucagccucaugaagucccucgggggcgggcggcgcgggaccggcgcccagggggagacgcugggcgagaaguggaagcggcagcucaaccagcugagcaaguccgaguucaacaccuacaagcgcagcgggaucauggagguggaccgguccgaggccaaggagggccugaagcgcggcgagaccaccaagcacgccgugagccgggggacggcgaagcuccgcugguucgucgagcggaaccuggugaagcccgagggcaaggugaucgaccuggggugcggccgcgggggcugguccuacuacugcgccggccugaagaaggucaccgaggugaagggguacaccaagggcgggcccggccacgaggagcccaucccgauggccaccuacggguggaaccucgugaagcugcacagcggcaaggacgucuucuucaucccgcccgagaagugcgacacgcugcucugcgacaucggcgaguccagccccaacccgaccaucgaggaggggcggacccugcgcgugcugaagaugguggagcccuggcuccggggcaaccaguucugcaucaagauccugaaccccuacaugcccuccgucguggagacccuggagcagaugcagcgcaagcacgggggcaugcucgugcggaacccgcugagccgcaacuccacgcacgagauguacugggucagcugcggcaccgggaacaucguguccgccgugaacaugaccagccggaugcugcucaaccgcuucaccauggcccaccggaagcccacguacgagcgcgacgucgaccugggcgcggggacccgccacguggccguggagcccgaggucgccaaccuggacaucaucggccagcggaucgagaacaucaagcacgagcacaaguccaccuggcacuacgacgaggacaacccguacaagaccugggccuaccacgggagcuacgaggugaagcccuccggcagcgccagcuccauggugaacggcgucgugaagcuccugacgaagcccugggacgucauccccauggugacccagaucgcgaugaccgacaccaccccguucgggcagcagcgcguguucaaggagaaggucgacacgcggacccccaaggccaagcgcggcaccgcccagaucauggaggugaccgccaaguggcuguggggguuccucagccggaacaagaagccccgcaucugcacgcgggaggaguucacccgcaaggugcgguccaacgcggccaucggcgccgucuucguggacgagaaccaguggaacagcgccaaggaggccguggaggacgagcgcuucugggaccugguccaccgggagcgcgagcugcacaagcaggggaagugcgcgaccugcguguacaacaugaugggcaagcgggagaagaagcucggcgaguucgggaaggccaagggcucccgcgccaucugguacauguggcugggggcccgguuccuggaguucgaggcccucggcuucaugaacgaggaccacugguucagccgcgagaacucccugagcgggguggagggcgagggccugcacaagcucggguacauccugcgggacaucuccaagauccccggcgggaacauguacgcggacgacaccgccggcugggacacgcgcaucaccgaggacgaccugcagaacgaggccaagaucaccgacaucauggagccggagcacgcccuccuggccaagagcaucuucaagcugaccuaccagaacaaggucgugcgggugcagcgccccgcgaagaacggcacggucauggacgugaucucccggcgcgaccagcgcgggagcggccagguggggaccuacggccucaacaccuucaccaacauggaggcccagcugauccggcagauggaguccgaggggaucuucagccccuccgagcuggagacgcccaaccucgccggccgcguccuggacuggcuggagaagcacggcguggagcggcucaagcgcauggccaucagcggggacgacugcguggucaagccgaucgacgaccgguucgccgcggcccugaccgcccugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcugguggggcgggcccgcgucagccagggcgcgggcuggucccugcgggagaccgccugccucggcaagagcuacgcccagauguggcagcugauguacuuccaccgccgggaccugcgccucgccgccaacgcgaucugcuccgccgugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccuggggaagcgggaggaccaguggugcggcucccucaucgggcugaccgcccgcgccaccugggcgaccaacauccagguggccaucaaccaggugcggcgccugaucggcaacgagaacuaccucgacuacaugacgagcaugaagcgcuucaagaacgaguccgaccccgagggcgcccugugguga

SEQ ID NO: 8700 - RNA, 9879 nt, Artificial Sequence
  derived and/or modified CDS sequence (opt1) from DENV-1__GU131806__SS-prME
agcgugaccauguuccugaugcucaugcccaccgcccuggccuuccaccugaccacccggggcggggagccccacaugaucgucagcaagcaggagcggggcaagagccuccuguucaagaccagcgccggggugaacaugugcacccugaucgccauggaccucggcgagcugugcgaggacaccaugaccuacaagugcccccggaucaccgagaccgagcccgacgacguggacugcuggugcaacgccacggacaccugggucaccuacgggaccugcagccagacgggcgagcaccggcgcgacaagcgguccguggcccuggcgccccacgugggccucgggcuggagacccgcaccgagaccuggaugagcuccgagggcgcguggaagcagauccagcgggucgagacgugggcccugcgccacccgggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugccccacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccgcuggccuggaccagcgggggcagcacgucccaggagaccuggaaccggcaggaccucguggucaccuucaagaccgcccacggcaagaagcaggagguggugguccuggggagccaggagggcgccaugcacacggcgcugaccggggccaccgagauccagaccuccggcacgaccaccaucuucgccgggcaccucaagugccgccugaagauggacaagcugacccucaagggcaugagcuacgugaugugcacgggcuccuucaagcuggagaaggagcuggccgagacccagcacgggaccgugcucguccagaucaaguacgagggcaccgacgcccccugcaagauccccuucagcacgcaggacgagaagggggugacccagaacggccggcugaucaccgcgaaccccaucgugaccgacaaggagaagccggucaacaucgaggccgagccgcccuucggcgaguccuacaucgugaucggggccggcgagaaggcccugaagcugagcugguucaagaagggguccagcaucggcaagauguucgaggcgacggcccgcggggcccggcgcauggccauccucggcgacaccgccugggacuucggcuccaucgggggcguguucaccagcgucgggaagcuggugcaccagaucuucggcaccgcguacggggugcuguucuccggcgucagcuggacgaugaagaucggcaucggggugcuccugaccuggcugggccucaacucccgcagcaccucccugagcaugaccugcaucgccguggggcuggucacgcucuaccugggcgugauggugcaggccgacuccgggugcgucaucaacuggaagggccgggagcugaagugcggcagcgggaucuucgugaccaacgaggugcacaccuggaccgagcaguacaaguuccaggccgacagccccaagcgccucuccgccgcgaucggcaaggccugggaggagggggucugcggcauccggagcgccacccgccuggagaacaucauguggaagcagaucuccaacgagcugaaccacauccuccuggagaacgacaugaaguucacggugguggucggggacguggccggcauccuggcccagggcaagaagaugauccggccgcagcccauggaguacaaguacagcuggaaguccugggggaaggcgaagaucaucggcgccgacgugcagaacaccaccuucaucaucgacgggcccaacacccccgagugcccggacgaccagcgcgccuggaacaucugggaggucgaggacuacggcuucggcaucuucacgaccaacaucuggcucaagcugcgggacagcuacacccaggugugcgaccaccgccugauguccgccgcgaucaaggacagcaaggccgugcacgccgacaugggguacuggaucgaguccgagaagaacgagaccuggaagcucgcccgggccagcuucaucgaggucaagacgugcaucuggcccaagucccacacccuguggagcaacggcgugcuggaguccgagaugaucauccccaagaucuacgggggccccaucagccagcacaacuaccgcccgggguacuucacccagaccgcgggccccuggcaccucgccaagcuggagcuggacuucgaccucugcgagggcacgaccguggucguggacgagcacugcgggaaccggggccccucccugcgcaccaccacggugaccgggaagaucauccacgaguggugcugccggagcugcacccugccgccccuccgcuuccggggcgaggacgggugcugguacggcauggagauccgccccgucaaggagaaggaggagaaccuggugaaguccauggugagcgccggcagcggggaggucgacuccuucagccugggccuccugugcaucuccaucaugaucgaggaggugaugcggagccgcuggucccggaagaugcugaugaccgggacgcucgccguguucuuccugcugaucaugggccagcucaccuggaacgaccugauccgccugugcaucauggucggggccaacgcgagcgaccgcaugggcaugggcaccaccuaccucgcccugauggccacguucaagaugcggcccauguucgccguggggcuccuguuccgccggcugaccucccgcgaggugcugcuccugaccaucgggcugagccucgucgccuccguggagcugccgaacagccuggaggagcucggggacggccuggcgaugggcaucaugauccugaagcuccugaccgacuuccagucccaccagcugugggccacgcuccugagccugaccuucaucaagaccaccuucucccuccacuacgccuggaagacgauggccaugguccugagcaucgugucccuguucccccucugccugagcaccaccucccagaagaccacguggcugcccgugcuccuggggagccugggcugcaagccccucaccauguuccugaucgcggagaacaagaucugggggcggcgcuccuggccgcugaacgagggcaucauggccgucgggaucgugagcauccuccugagcucccugcucaagaacgacgugccccuggccggcccccugaucgccggcgggaugcucaucgccugcuacgucaucagcggcuccagcgcggaccugucccuggagaaggccgccgaggugagcugggaggaggaggccgagcacuccgggcccagccacaacauccucguggagguccaggacgacggcccgaugaagaucaaggacgaggagcgggacgacacccugaccauccugcucaaggccacccugcuggcgguguccgggguguacccccucagcauccccgccacgcuguucgucugguacuucuggcagaagaagaagcagcgcuccggcgugcugugggacacccccagcccgcccgagguggagcgggccguccucgacgacggcaucuaccgcaucaugcagcgggggcugcugggccgcucccaggugggggugggcgucuuccaggagaacguguuccacaccauguggcacgugacccgcggggccguccugauguaccagggcaagcgccucgagcccagcugggccuccgugaagaaggaccugaucagcuacggcgggggcuggcggcugcagggguccuggaacacgggcgaggaggugcaggucaucgcgguggagcccgggaagaacccgaagaacgugcagaccgcccccggcaccuucaagacccccgagggcgaggucggggccaucgcccucgacuucaagcccggcacgagcggguccccgaucgugaaccgcgagggcaagauccugggccuguacgggaacggcguggucaccaccagcgggaccuacgugagcgccaucgcgcaggcccgggccucccaggagggcccccuccccgagaucgaggacgagguguuccgcaagcggaaccugacgaucauggaccugcacccggggagcggcaagacccgccgguaccuccccgccaucguccgcgaggcgaucaagcgcaagcugcggacccugauccucgcccccacccgcgugguggccuccgagauggccgaggcccugaagggcaugcccauccgguaccagacgaccgcggucaagagcgagcacaccgggaaggagaucguggaccugaugugccacgccaccuucacgaugcgccuccuguccccggugcggguccccaacuacaacaugaucaucauggacgaggcccacuucaccgaccccagcuccaucgccgcccgcggcuacaucagcacccggguggggaugggcgaggcggccgccaucuucaugaccgccacgcccccgggguccguggaggccuucccccagagcaacgcggucauccaggacgaggagcgcgacauccccgagcgguccuggaacagcggcuacgaguggaucaccgacuuccccggcaagaccgugugguucgugccguccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggccaacuuccgggccgaccgcgucaucgacccccggcgcugccugaagcccgugauccugaaggacggccccgagcgggugauccucgcggggccgaugcccgucacgguggccuccgccgcccagcgccggggccgcaucggccgcaaccacaacaaggagggggaccaguacaucuacaugggccagccccugaacaacgacgaggaccacgcccacuggaccgaggcgaagaugcugcucgacaacaucaacacccccgaggggaucaucccggcccuguucgagcccgagcgggagaaguccgccgccaucgacggcgaguaccgccugcgcggggaggcccgcaagaccuucgucgagcucaugcggcgcggcgaccugcccguguggcuguccuacaagguggcgagcgagggcuuccaguacagcgaccggcgcuggugcuucgacggggagcggaacaaccagguccucgaggagaacauggacguggagaucuggacgaaggagggcgagcgcaagaagcugcggccccgcuggcuggacgcccggaccuacuccgacccgcucgcccugcgcgaguucaaggaguucgccgccgggcggcgcagcguguccggcgaccugauccucgagaucggcaagcugccccagcaccugacccagcgggcgcagaacgcccucgacaaccuggucaugcugcacaacagcgagcagggcgggcgcgccuaccggcacgccauggaggagcuccccgacaccaucgagacgcugaugcugcucgcgcugaucgccgugcugaccgggggcgugacccucuucuuccuguccgggcgcggccugggcaagaccagcaucgggcuccugugcgucauggccuccagcgugcugcucuggauggccuccguggagccccacuggaucgccgcgagcaucauccuggaguucuuccugaugguccuccugaucccggagcccgaccggcagcgcacgccccaggacaaccagcuggccuacguggugaucggccuccuguucaugauccugacggucgccgccaacgagauggggcuccuggagaccaccaagaaggaccugggcaucgggcacguggccguggagaaccaccaccacgcggccaugcucgacgucgaccugcacccggccuccgccuggacccuguacgccguggcgacgaccaucaucacccccaugaugcgccacaccaucgagaacacgaccgccaacaucagccucaccgccaucgccaaccaggccgcgauccugaugggccuggacaagggcuggcccaucuccaagauggacaucggggugccccuccuggcccugggcugcuacagccaggucaacccgcucacccugacggccgccgugcugaugcucguggcgcacuacgccaucaucgggcccggccugcaggccaaggccacccgggaggcccagaagcgcaccgcggccgggaucaugaagaaccccaccgucgacggcaucguggccaucgaccuggaccccguggucuacgacgccaaguucgagaagcagcucggccagaucaugcugcugauccucugcacgucccagauccugcugaugcggaccaccugggcccucugcgagagcaucacccuggcgacggggccgcugaccacccucugggagggcucccccgggaaguucuggaacaccacgaucgccgugagcauggccaacaucuuccgcggcuccuaccuggccggcgccgggcuggcguucagccucaugaagucccugggcgggggccggcgcgggaccggcgcccagggcgagacccugggggagaaguggaagcggcagcucaaccagcuguccaagagcgaguucaacaccuacaagcgcuccggcaucauggagguggaccggagcgaggccaaggaggggcugaagcgcggcgagacgaccaagcacgccgucucccgggggaccgcgaagcuccgcugguucguggagcggaaccuggugaagcccgagggcaaggucaucgaccugggcugcgggcgcggcggguggagcuacuacugcgccggccugaagaaggugaccgaggugaagggguacacgaagggcggccccgggcacgaggagccgauccccauggccaccuacggcuggaaccucgucaagcugcacuccgggaaggacguguucuucaucccgcccgagaagugcgacacccugcucugcgacaucggcgagagcuccccgaaccccaccaucgaggaggggcggacgcugcgcgugcugaagauggucgagcccuggcuccggggcaaccaguucugcaucaagauccugaaccccuacaugccgagcgugguggagacccuggagcagaugcagcgcaagcacggcgggaugcucguccggaacccccugucccgcaacagcacccacgagauguacuggguguccugcggcaccgggaacaucgugagcgccgucaacaugaccucccgcaugcugcucaaccgguucacgauggcccaccgcaagcccaccuacgagcgggacguggaccugggcgcgggcacccgccacguggccgucgagcccgagguggccaaccuggacaucaucgggcagcggaucgagaacaucaagcacgagcacaagagcaccuggcacuacgacgaggacaacccguacaagacgugggccuaccacggcuccuacgaggugaagcccagcggguccgccagcagcauggucaacggcguggucaagcuccugaccaagcccugggacgugauccccauggugacccagaucgcgaugaccgacacgaccccguucgggcagcagcgcgucuucaaggagaagguggacacccggacccccaaggccaagcgcggcacggcccagaucauggaggugaccgccaaguggcuguggggcuuccucucccggaacaagaagccccgcaucugcacccgggaggaguucacccgcaagguccggagcaacgccgcgaucggggccguguucguggacgagaaccaguggaacuccgccaaggaggccgucgaggacgagcgcuucugggaccuggugcaccgggagcgcgagcugcacaagcagggcaagugcgcgacgugcguguacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcgucgagggggagggccugcacaagcucggguacauccugcgggacaucagcaagaucccgggcggcaacauguacgcggacgacaccgccgggugggacacccgcaucaccgaggacgaccugcagaacgaggcccgcaucacggacaucauggagcccgagcacgcccuccuggccaaguccaucuucaagcugaccuaccagaacaagguggugcggguccagcgccccgcgaagaacggcaccgugauggacgugaucagccggcgcgaccagcggggguccggccaggucggcaccuacgggcucaacacguucaccaacauggaggcccagcugauccgccagauggagagcgagggcaucuucucccccagcgagcuggagaccccgaaccucgccgagcgggugcuggacuggcuggagaaguacgggguggagcgccucaagcggauggccaucuccggcgacgacugcgucgugaagcccaucgacgaccgcuucgccaccgcgcugacggcccugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgcggugcccgucgacuggauccccaccucccgcaccacguggagcauccacgcccaccaccaguggaugaccaccgaggacaugcuguccguguggaaccgcguguggaucgaggagaacccguggauggaggacaagacccacaucagcuccuggggcgacguccccuaccugggcaagcgggaggaccaguggugcggcagccucaucgggcugacggcccgcgccaccugggccaccaacauccagguggcgaucaaccaggugcggcgccugaucggcaacgagaacuaccucgacuacaugaccuccaugaagcgguucaagaacgagagcgaccccgagggggcccugugguga

SEQ ID NO: 8701 - RNA, 9879 nt, Artificial Sequence
  derived and/or modified CDS sequence (opt1) from DENV-1__GU131807__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagcccgaggucaccaacccggccgugcugcggaagcucugcaucgaggcgaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgccaccaucacgccccaggcgcccacgaccgagauccagcucaccgacuacggggcccugacccuggacugcagcccgcgcacgggccucgacuucaacgagaugguccuggugaccaugaaggagaaguccuggcuggugcacaagcagugguuccucgaccugccccugcccuggaccagcggggccagcaccucccaggagacguggaaccggcaggaccuccuggucaccuucaagaccgcccacgccaagaagcaggagguggugguccugggcagccaggagggcgcgaugcacaccgcccucacgggggccaccgagauccagaccuccggcaccacgaccaucuucgccgggcaccugaagugccgccugaagauggacaagcucacccugcggggcaugagcuacgugaugugcaccggguccuucaagcuggagaaggagguggccgagacgcagcacggcaccguccucgugcagaucaaguacgagggcaccgacgcgcccugcaagaucccguucagcacccaggacgagaagggggugacgcagaacggccgccugaucaccgccaaccccaucgucaccgacaaggagaagcccgugaacaucgaggccgagcccccguucggggaguccuacaucgugaucggcgccggcgagaaggcgcugaagcugagcugguucaagaagggguccagcaucggcaagauguucgaggccaccgcccgcggggcccgccgcauggccauccucggcgacacggcgugggacuucggguccaucggcggcgucuucaccagcguggggaagcuggugcaccagaucuucggccccgccuacgggguccuguucuccggcgugagcuggcccaugaagaucgggaucggcgugcuccugaccuggcugggccucaacucccggagcaccucccugagcaugacgugcaucgccgucgggcuggugacccucuaccugggcgugaugguccaggccgacuccgggugcgugaucaacuggaagggccgcgagcugaagugcgggagcggcaucuucgugaccaacgagguccacaccuggacggagcaguacaaguuccaggccgacagccccaagcggcucuccgcggccaucggcaaggccugggaggagggggugugcggcauccgcagcgccacccggcuggagaacaucauguggaagcagaucuccaacgagcugaaccacauccuccuggagaacgacaugaaguucaccguggucgugggggacguggccggcauccuggcgcaggggaagaagaugauccgcccgcagcccauggaguacaaguacagcuggaaguccuggggcaaggccaagaucaucggcgccgacguccagaacaccaccuucaucaucgacgggcccaacacgcccgagugcccggacgaccagcgggccuggaacaucugggagguggaggacuacggcuucgggaucuucaccaccaacaucuggcucaagcugcgcgacagcuacacccaggugugcgaccaccggcugauguccgcggccaucaaggacagcaaggccguccacgccgacaugggcuacuggaucgaguccgagaagaacgagacguggaagcucgcccgcgcgagcuucaucgaggugaagaccugcaucuggcccaagucccacacccuguggagcaacggcgugcuggaguccgagaugaucauccccaagaucuacgggggcccgaucagccagcacaacuaccggcccggguacuucacccagacggccggccccuggcaccucgggaagcuggagcuggacuucgaccucugcgagggcaccaccgucgugguggacgaccacugcggcaaccgcgggcccucccugcggaccacgaccgucaccggcaagaucauccacgaguggugcugccgcagcugcacccugccgccccuccgguuccgcggggaggacggcugcugguacgggauggagauccggcccgugaaggagaaggaggagaaccuggugaaguccauggucagcgccggcagcggcgagguggacuccuucagccuggggcuccugugcaucuccaucaugaucgaggaggugaugcgcagccgguggucccgcaagaugcugaugacgggcacccucgccgucuucuuccugcugaucauggggcagcucaccuggaacgaccugauccgccugugcaucauggugggcgccaacgcgagcgaccggauggggaugggcaccacguaccucgcccugauggccaccuucaagauccgccccauguucgccguggggcuccuguuccggcgccugaccucccgggagguccugcuccugaccaucgggcugagccucguggccuccgucgagcugccgaacagccuggaggagcucggcgacgggcuggcgaugggcaucaugauccugaagcuccugacggacuuccagucccaccagcugugggccacccuccugagccugaccuucaucaagaccacguucucccuccacugcgccuggaagaccauggccauggugcugagcaucgugucccuguucccccucugccugagcaccaccucccagaagacgaccuggcugcccguccuccugggcagccuggggugcaagccccucaccauguuccugaucgcggagaacaagaucuggggccgccgguccuggccgcugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgcgacgacacgcugaccauccugcucaaggcgacccugcuggccguguccggcgucuacccccucagcaucccggccacccuguucgugugguacuucuggcagaagaagaagcagcgguccggggugcugugggacacccccuccccgcccgaggucgagcgcgccgugcucgacgacggcaucuaccggaucaugcagcgcggccugcuggggcggucccaggugggcgucgggguguuccaggagaacguguuccacacgauguggcacgucacccgcggcgccgugcugauguaccaggggaagcggcucgagccgagcugggcguccgugaagaaggaccugaucagcuacggcggcggguggcgccugcagggcuccuggaacaccggggaggagguccaggugaucgccguggagcccggcaagaaccccaagaacguccagaccgcccccgggacguucaagaccccggagggcgaggugggcgccaucgcccucgacuucaagcccgggaccagcggcucccccaucgugaaccgggaggggaagaucgucggccuguacggcaacgggguggugaccacgagcggcaccuacgucagcgcgaucgcccaggccaaggccucccaggaggggccgcugcccgagaucgaggacgagguguuccgcaagcggaaccucaccaucauggaccugcaccccggcagcgggaagacccgccgguaccugcccgcgaucgugcgcgaggccaucaagcgcaagcuccggacgcugauccuggccccgacccgcgucguggccuccgagauggccgaggcgcucaagggcaugcccauccgguaccagaccaccgccgucaagagcgagcacacgggcaaggagaucgucgaccugaugugccacgccaccuucaccaugcgccugcucucccccgugcgggugcccaacuacaacaugaucaucauggacgaggcccacuucaccgacccgagcuccaucgccgcgcgcggguacaucagcacgcgggucggcaugggggaggccgccgccaucuucaugaccgccacgccgcccggcuccguggaggcguucccccagagcaacgccgugauccaggacgaggagcgcgacaucccggagcgguccuggaacagcggguacgaguggaucaccgacuuccccggcaagacggucugguucgugcccuccaucaagagcggcaacgacaucgccaacugccugcgcaagaacgggaagcgggugauccagcugucccgcaagaccuucgacaccgaguaccagaagaccaagaacaacgacugggacuacgucgugacgaccgacaucagcgagaugggcgccaacuuccgggcggaccgcgugaucgacccccggcgcugccucaagccggucauccugaaggacgggcccgagcgggugauccuggccggccccaugcccgucaccguggccuccgccgcccagcgccgggggcgcaucggccgcaaccacaacaaggagggcgaccaguacaucuacauggggcagccgcucaacaacgacgaggaccacgcgcacuggaccgaggccaagaugcugcuggacaacaucaacacgcccgagggcaucauccccgcccucuucgagcccgagcgggagaaguccgccgccaucgacggggaguaccgccugcggggcgaggcgcgcaagaccuucguggagcugaugcggcgcggggaccucccggucuggcuguccuacaagguggccagcgagggcuuccaguacagcgaccggcgcuggugcuucgacggcgagaagaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccccagcaccugacgcagcgcgcccagaacgcccuggacaaccucgugaugcugcacaacagcgagcagggcgggcgggccuaccgccacgcgauggaggagcugccggacaccaucgagacccucaugcugcuggcccucaucgccguccugaccggcggggugacgcuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggacaagcagcgcacgccccaggacaaccagcuggccuacgucgugaucgggcuccuguucaugauccugaccguggccgccaacgagaugggccugcucgagaccacgaagaaggaccuggggaucggccacgucgcgguggagaaccaccaccacgccgccaugcuggacguggaccuccaccccgccuccgccuggacccuguacgcggucgccaccaccaucaucacgcccaugaugcggcacaccaucgagaacaccaccgccaacaucagccugacggccaucgccaaccaggcggccauccucauggggcuggacaagggcuggccgaucuccaagauggacaucggcgugccccugcucgcccuggggugcuacagccaggugaacccccugacccucaccgccgcgguccugaugcugguggcccacuacgccaucaucggccccgggcuccaggccaaggccacccgcgaggcgcagaagcgcacggccgccggcaucaugaagaacccgaccguggacgggaucgucgccaucgaccuggaccccgugguguacgacgccaaguucgagaagcagcugggccagaucaugcuccugauccugugcaccucccagauccuccugaugcggaccacgugggcgcugugcgagagcaucacccucgccaccggcccccugaccacgcugugggaggggucccccggcaaguucuggaacaccaccaucgccgucagcauggccaacaucuuccgcggguccuaccucgccggcgcgggccuggccuucagccugaugaagucccucgggggcgggcggcgcggcaccggggcccagggcgagacgcugggcgagaaguggaagcggcagcugaaccagcucuccaagagcgaguucaacaccuacaagcgcuccgggaucauggagguggaccggagcgaggccaaggagggccugaagcgcggggagaccaccaagcacgcggugucccggggcacggccaagcugcgcugguucgucgagcggaaccucgugaagccggaggggaaggugaucgaccugggcugcggccgcgggggcuggagcuacuacugcgccgggcugaagaaggucaccgaggugaagggcuacaccaagggcgggcccggccacgaggagcccauccccauggccaccuacggguggaaccuggugaagcuccacuccggcaaggacgucuucuucaucccgcccgagaagugcgacacgcugcugugcgacaucggggagagcucccccaaccccaccaucgaggagggccggacccuccgcgugcugaagaugguggagccguggcugcgggggaaccaguucugcaucaagauccucaaccccuacaugcccagcgucguggagacccuggagcagaugcagcgcaagcacggcggcaugcuggugcggaacccccucucccgcaacagcacgcacgagauguacugggucuccugcgggaccggcaacaucgugagcgccgugaacaugaccucccggaugcugcugaaccgcuucaccauggcgcaccgcaagccgaccuacgagcgggacgucgaccucggggccggcacgcgccacguggccguggagcccgaggucgccaaccuggacaucaucggccagcggaucgagaacaucaagcacgagcacaagagcaccuggcacuacgacgaggacaaccccuacaagaccugggccuaccacggguccuacgaggugaagcccagcggcuccgcgagcagcauggucaacgggguggugaagcugcucaccaagccgugggacgucauccccauggugacgcagaucgccaugaccgacaccacccccuucggccagcagcgcguguucaaggagaaggucgacacgcggaccccgaaggccaagcgcgggaccgcccagaucauggaggugaccgccaaguggcuguggggcuuccugucccggaacaagaagccccgcaucugcacgcgggaggaguucacccgcaaggugcggagcaacgcggccaucggcgccgucuucguggacgagaaccaguggaacuccgccaaggaggcgguggaggacgagcgcuucugggaccucguccaccgggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacgcgcaucaccgaggacgaccugcagaacgaggcccggaucaccgacaucauggagcccgagcacgcccugcucgcgaaguccaucuucaagcugaccuaccagaacaaggucgugcgcgugcagcgcccggccaagaacgggacggucauggacgugaucagccggcgcgaccagcggggcuccggccaggugggcaccuacggccugaacaccuucaccaacauggaggcccagcucauccgccagauggagagcgaggggaucuucucccccagcgagcuggagacgcccaaccuggccgagcggguccucgacuggcuggagaaguacggcguggagcgccugaagcggauggccaucuccggggacgacugcguggucaagcccaucgacgaccgcuucgcgaccgcccucaccgcccugaacgacaugggcaaggugcggaaggacaucccgcagugggagcccagcaagggguggaacgacuggcagcagguccccuucugcucccaccacuuccaccagcugaucaugaaggacggccgcgagaucgucgugcccugccggaaccaggacgagcucgugggccgcgcccgggucagccagggggccggcuggagccugcgcgagaccgcgugccuggggaaguccuacgcccagauguggcagcucauguacuuccaccggcgcgaccugcggcuggccgccaacgcgaucugcagcgccgugccgguggacuggauccccacgucccgcaccaccuggagcauccacgcccaccaccaguggaugaccacggaggacaugcucuccgucuggaaccggguguggaucgaggagaaccccuggauggaggacaagacccacaucagcuccuggggcgacgugcccuaccuggggaagcgcgaggaccaguggugcggcagccugaucggccucaccgcccgcgccaccugggcgacgaacauccaggucgccaucaaccaggugcggcgccugaucgggaacgagaacuaccuggacuacaugaccuccaugaagcgguucaagaacgagagcgacccggagggcgcccucugguga

SEQ ID NO: 8702 - RNA, 9879 nt, Artificial Sequence
  derived and/or modified CDS sequence (opt1) from DENV-1__GU131811__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggggaguucugcgaggacaccaugaccuacaagugcccccgcaucaccgaggccgagcccgacgacguggacugcuggugcaacgccaccgacacgugggugaccuacgggaccugcagccagaucggggagcaccggcgcgacaagcgguccguggcccuggcgccccacgugggccucgggcuggagacccgcacggagaccuggaugagcuccgagggcgccuggaagcagauccagcggguggagaccugggcccugcgccaccccggguucaccgugaucgcccucuuccuggcgcacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggccaaggacaagcccacccuggacaucgagcugcucaagaccgaggucacgaaccccgcggugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgccaaguucaagugcgugacgaagcucgagggcaagaucguccaguacgagaaccugaaguacagcgugaucgugaccguccacaccggcgaccagcaccagguggggaacgaguccaccgagcacggcacgaccgcgaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggugacccagaacggccggcugaucaccgccaacccgaucgugacggacaaggagaagcccgucaacaucgaggccgagccgcccuucggggagagcuacaucgugaucggcgugggcgagaaggcgcugaagcuguccugguucaagaaggggagcuccaucggcaagauguucgagaccaccgcccgcggggcccggcgcauggccauccucggcgacaccgccugggacuucgggagcaucggcggcgucuucacguccguggggaagcuggugcaccagaucuucggcaccgcguacgggguccuguucagcggcguguccuggaccaugaagaucgggaucggcgugcuccugaccuggcugggccucaacagccgcuccacgagccuguccaugaccugcaucgccgucgggcuggugacccucuaccugggcgugaugguccaggccgacagcgggugcgugaucaacuggaagggccgggagcugaagugcgggagcggcaucuucgugaccaacgagguccacacguggaccgagcaguacaaguuccaggccgacuccccgaagcgccucagcgccgcgaucggcaaggccugggaggagggggugugcggcauccgguccgccacccgccuggagaacaucauguggaagcagaucagcaacgagcugaaccacauccuccuggagaacgacaugaagcugaccguggucgugggggacguggccggcauccucgcccaggggaagaagaugauccggccccagcccauggaguacaaguacuccuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacuccuacacccaggugugcgaccaccgccucaugagcgccgcgaucaaggacuccaaggccguccacgccgacaugggcuacuggaucgagagcgagaagaacgagaccuggaagcuggcccgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacgcagaccgcgggccccuggcaccuggggaagcuggagcucgacuucgaccugugcgagggcaccaccgucgugguggacgagcacugcggcaaccgggggccgagccugcgcacgaccaccgucaccggcaagaucauccacgaguggugcugccgguccugcacgcugccgccccuccgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugaccggcacccuggccgucuucuuccugcucaucauggggcagcugaccuggaacgaccugauccggcucugcaucauggugggcgccaacgccuccgaccgcauggggaugggcacgaccuaccuggcgcugauggccaccuucaagaugcgcccgauguucgccgugggccuccuguuccggcgccugaccagccgggagguccuccugcugacgaucgggcucucccugguggccagcgucgagcugcccaacucccucgaggagcugggcgacgggcuggccaugggcaucaugauccucaagcugcugaccgacuuccagagccaccagcucugggcgacccugcuguccaugaccuucauccgcacgaccuucagccuccacuacgccuggaagaccauggccauggugcuguccaucgugagccuguucccccucugccuguccaccacgagccagaagaccaccuggcugcccguccuccugggcucccuggggugcaagccgcucaccauguuccugaucgccgagaacaagaucuggggccgcaagagcuggccccugaacgaggggaucauggcggugggcaucgugagcauccuccuguccagccugcucaagaacgacgucccccuggccgggccccugaucgccggcggcaugcucaucgccugcuacgugaucuccgggagcuccgccgaccugagccuggagaaggcggccguggucuccugggaggaggaggccgagcacagcggcgccucccacaacauccucguggaggugcaggacgacgggacgaugaagaucaaggacgaggagcgcgacgacacccugaccauccugcucaaggccacccugcuggcggucagcggcguguacccgcucuccauccccgccacccuguucgugugguacuucuggcagaagaagaagcagcggagcgggguccugugggacacgcccagcccgcccgagguggagcgcgccgugcucgacgacggcaucuaccggaucaugcagcgcggccugcuggggcggagccaggucggcguggggguguuccaggagaacgucuuccacaccauguggcacgugacccgcggcgccgugcugauguaccaggggaagcggcucgagcccuccugggccagcgucaagaaggaccugaucuccuacggcggcggguggcgccugcagggcagcuggaacaccggggaggagguccaggugaucgcggucgagcccggcaagaaccccaagaacgugcagacggcccccgggaccuucaagaccuccgagggcgaggugggcgccaucgcccucgacuucaagcccgggaccagcggcagccccaucgucaaccgggaggggaagguggugggccuguacggcaacggggucgugacgaccuccggcaccuacgugagcgccaucgcgcaggccaaggccucccaggaggggccccugccggagaucgaggacgaggucuuccgcaagcggaaccucaccaucauggaccugcaccccggcagcgggaagacgcgccgguaccugcccgccaucgugcgcgaggcgaucaagcggaagcuccgcacccugauccuggccccgacccgcguggucgccuccgagauggccgaggcccucaagggcaugcccauccgguaccagaccacggcggucaagagcgagcacaccggcaaggagaucguggaccugaugugccacgccaccuucaccaugcgccugcucucccccguccgggugcccaacuacaacaugaucaucauggacgaggcccacuucacggacccgagcuccaucgccgcccgcggguacaucagcacccgggugggcaugggggaggcggccgccaucuucaugaccgccacgccgcccggcuccgucgaggccuucccccagagcaacgcggugauccaggacgaggagcgcgacaucccggagcgguccuggaacagcggguacgaguggaucacggacuuccccggcaagaccgugugguucguccccuccaucaagagcggcaacgacaucgccaacugccugcgcaagaacgggaagcgggugauccagcugucccgcaagaccuucgacaccgaguaccagaagacgaagaacaacgacugggacuacguggucaccaccgacaucagcgagaugggcgccaacuuccgggccgaccgcgugaucgacccccggcgcugccucaagccggucauccugaaggacgggcccgagcgggugauccuggcgggccccaugcccgugaccgucgccuccgccgcccagcgccgggggcgcaucggccggaaccacaacaaggagggcgaccaguacaucuacauggggcagccgcucaacaacgacgaggaccacgcccacuggacggaggcgaagaugcugcuggacaacaucaacacccccgagggcaucauccccgcccucuucgagcccgagcgcgagaaguccgccgccaucgacggggaguaccgccugcggggcgaggcccgcaagaccuucguggagcugaugcggcgcggggaccucccgguguggcugagcuacaaggucgcguccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggacguacuccgacccccuggcccuccgcgaguucaaggaguucgccgccggccggcgcagcgucuccggggaccugauccuggagaucggcaagcucccccagcaccugacccagcgggcgcagaacgcccuggacaaccucgugaugcugcacaacagcgagcagggcgggcgcgccuaccggcacgccauggaggagcugccggacaccaucgagacccucaugcugcuggcgcucaucgccgugcugacgggcggggucacccuguucuuccucuccggccgcgggcugggcaagaccagcaucggccugcucugcgugauggccuccagcgugcugcuguggauggccuccgucgagccccacuggaucgccgcgagcaucauccucgaguucuuccugauggugcugcucauccccgagcccgaccggcagcgcaccccgcaggacaaccagcuggccuacguggucaucgggcuccuguucaugauccugaccguggccgccaacgagaugggccugcucgagacgaccaagaaggaccuggggaucggccacguggccgucgagaaccaccaccacgcggccaugcuggacguggaccuccaccccgccuccgccuggacccuguacgccguggcgaccacgaucaucacccccaugaugcggcacaccaucgagaacaccacggccaacaucagccugaccgccaucgccaaccaggccgcgauccucauggggcuggacaagggcuggccgaucuccaagauggacaucggcgucccccugcucgcccuggggugcuacagccaggugaacccccugacccucaccgccgccgugcugaugcuggucgcgcacuacgccaucaucggccccgggcuccaggccaaggccacgcgcgaggcccagaagcgcaccgcggccggcaucaugaagaacccgaccguggacgggaucguggccaucgaccuggaccccgucguguacgacgccaaguucgagaagcagcugggccagaucaugcuccugauccugugcaccucccagauccuccugaugcggacgaccugggcccugugcgagagcaucacccucgcgaccggcccccugacgacccugugggaggggucccccggcaaguucuggaacaccaccaucgccgugagcauggccaacaucuuccgcgggagcuaccucgccggcgccggccuggcguucucccugaugaagucccucgggggcgggcggcgcggcacgggggcccagggcgagacccugggcgagaaguggaagcggcagcugaaccagcucuccaagagcgaguucaacaccuacaagcgcuccgggaucauggaggucgaccggagcgaggccaaggagggccugaagcgcggggagaccacgaagcacgccgugucccggggcaccgcgaagcugcgcugguucguggagcggaaccucgucaagccggaggggaaggugaucgaccugggcugcggccgcgggggcuggagcuacuacugcgccgggcugaagaaggugaccgaggucaagggcuacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccggacccuccgcguccugaagaugguggagccguggcugcgggggaaccaguucugcaucaagauccucaaccccuacaugcccagcguggucgagacgcuggagcagaugcagcgcaagcacggcggcaugcuggugcggaacccccucucccgcaacagcacccacgagauguacuggguguccugcgggaccggcaacaucgucagcgccgugaacaugaccucccggaugcugcugaaccgcuucaccauggcccaccgcaagccgacguacgagcgggacguggaccucggggcgggcacccgccacgucgccguggagcccgaggucgccaaccuggacaucaucggccagcggaucgagaacaucaagcacgagcacaagagcaccuggcacuacgacgaggacaaccccuacaagaccugggccuaccacggguccuacgaggugaagcccagcggcagcgccuccagcauggugaacggggucgugaagcugcucacgaagccgugggacgugauccccauggucacccagaucgcgaugaccgacaccacgcccuucggccagcagcgcguguucaaggagaagguggacacccggacccccaaggccaagcgcgggaccgcccagaucauggaggucacggccaaguggcuguggggcuuccugucccggaacaagaagccgcgcaucugcacccgggaggaguucacccgcaaggugcggagcaacgccgcgaucggcgccguguucgucgacgagaaccaguggaacuccgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacacggccggcugggacacccgcaucaccgaggacgaccugcagaacgaggccaagaucaccgacaucauggagcccgagcacgcccugcucgccaaguccaucuucaagcugacguaccagaacaaggugguccgggugcagcgcccggcgaagaacgggaccgugauggacgucaucagccgccgggaccagcgcggcuccggccaggugggcaccuacggccugaacaccuucacgaacauggaggcccagcucauccggcagauggagagcgaggggaucuucucccccagcgagcuggagacccccaaccuggccggccgcgcccucgacuggcuggagaagcacgggguggagcggcugaagcgcauggccaucuccggcgacgacugcgucgugaagcccaucgacgaccgguucgcgaccgcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcccgcgugucccagggcgccggguggagccugcgggagacggcgugccugggcaaguccuacgcccagauguggcagcucauguacuuccaccgccgggaccugcgccuggccgccaacgcgaucugcagcgccgugccggucgacugggugcccaccucccggaccaccuggagcauccacgcccaccaccaguggaugacgaccgaggacaugcucuccguguggaaccgcgucuggaucgaggagaaccccuggauggaggacaagacccacaucagcuccuggggcgacgugcccuaccugggcaagcgggaggaccaguggugcggcagccugaucgggcucaccgcccgcgccacgugggcgaccaacauccagguggccaucaaccagguccgccggcugcugggcaacgagaacuaccucgacuacaugaccuccaugaagcgcuucaagaacgagagcgacccggagggggcccugugguga

SEQ ID NO: 8703 - RNA, 9882 nt, Artificial Sequence
  derived and/or modified CDS sequence (opt1) from DENV-1__JF937615__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcggagcguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccgaccccgcggugcugcggaagcugugcaucgaggccaagaucuccaacaccaccacggacagccgcugccccacccagggcgaggccacccucguggaggagcaggacgccaacuucgucugccggcgcaccuucguggaccggggcugggggaacggcugcgggcuguucggcaaggggucccugaugacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgacagcuucaagcuggagaaggagguggcggagacccagcacgggacggugcucguccagaucaaguacgagggcaccgacgcccccugcaagauccccuucuccacccaggacgagaagggcgugacccagaacgggcggcugaucacggccaaccccaucgugaccgacaaggagaagcccgucaacaucgaggccgagccgcccuucggcgagagcuacaucgugaucggggcgggcgagaaggcccugaagcuguccugguucaagaagggcagcuccaucgggaagauguucgaggccaccgcccgcggcgcccggcgcauggcgauccucggggacaccgccugggacuucggcagcaucgggggcguguucacguccgucggcaagcuggugcaccagaucuucgggaccgccuacggcgugcuguucagcggggucuccuggaccaugaagaucggcaucggggugcuccugaccuggcugggccucaacagccgcuccacgagccuguccaugaccugcaucgccgugggccuggucacccucuaccugggggugauggugcaggccgacagcggcugcgucaucaacuggaaggggcgggagcugaagugcggcagcgggaucuucgugaccaacgaggugcacacguggaccgagcaguacaaguuccaggcggacuccccgaagcgccucagcgccgccaucggcaaggccugggaggagggcgucugcgggauccgguccgccacccgccuggagaacaucauguggaagcagaucagcaacgagcugaaccacauccuccuggagaacgacaugaaguucaccgugguggucggcgacguggcggggauccuggcccagggcaagaagaugauccggccccagcccauggaguacaaguacuccuggaaguccugggggaaggccaagaucaucggcgccgacgugcagaacaccacguucaucaucgacggccccaacaccccggagugccccgacgaccagcgcgcguggaacaucugggaggucgaggacuacggguucggcaucuucaccaccaacaucuggcucaagcugcgggacuccuacacccaggugugcgaccaccgccugaugagcgccgccaucaaggacuccaaggccgugcacgccgacaugggguacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacggcgggccgaucucccagcacaacuaccgccccggcuacuucacgcagaccgccgggcccuggcaccucggcaagcuggagcuggacuucgaccucugcgaggggaccaccguggucguggacgagcacugcggcaaccggggcccgagccugcgcacgaccaccgugaccgggaagaucauccacgaguggugcugccgguccugcacgcugccgccccugcgcuucaagggcgaggacgggugcugguacggcauggagauccggcccgucaaggagaaggaggagaaccuggucaagagcauggugagcgccggguccggcgaggucgacagcuucucccugggccuccugugcaucagcaucaugaucgaggaggugaugcgcucccgguggagccgcaagaugcugaugaccgggacccucgccguguucuuccugcugaucaugggccagcucaccuggaacgaccugauccggcugugcaucauggucggggcgaacgccuccgaccgcaugggcauggggacgaccuaccucgcccugauggccaccuucaagaugcgcccgauguucgccgugggccuccuguuccggcgccugaccagccgggaggugcugcuccugacgaucggccugucccucgucgcgagcguggagcugcccaacucccuggaggagcucggggacggccuggccauggggaucaugauccugaagcuccugaucgacuuccagagccaccagcugugggccacccuccugucccugaccuucaucaagaccacguucagccuccacuacgccuggaagaccauggcgaugguccuguccaucgugagccuguucccccuccugcccgugcacgaccugccgaagaagaccaccuggcuccccguccugcugggcucccucggcugcaagccccugacgauguuccugaucgccgagaacaagaucugggggcgcaagagcuggccccucaacgagggcaucauggccguggggaucguguccauccugcugagcgcccuccugaagaacgacgucccgcuggccggcccccucaucgccggcgggaugcugaucgccugcuacgugaucagcggguccagcgccgaccugucccucgagaaggccgccgaggugagcugggaggaggaggcggagcacuccggggccagccacaacauccuggucgaggugcaggacgacggcaccaugaagaucaaggacgaggagcgggacgacacccugaccauccuccugaaggccacgcugcucgccguguccggggucuacccccugagcauccccgccacccuguucgugugguacuucuggcagaagaagaagcagcgcuccggcgugcucugggacaccccguccccgcccgaggucgagcgggcggugcuggacgacgggaucuaccgcaucaugcagcggggccugcugggccgcucccaggugggggucggcguguuccaggagaacguguuccacaccauguggcacgucacccgcggggcggugcucauguaccagggcaagcggcuggagcccagcugggccuccgugaagaaggaccugaucagcuacgggggcggcuggcggcuccagggguccuggaacacgggcgaggagguccaggugaucgccguggagccggggaagaaccccaagaacguccagaccgcccccggcaccuucaagaccagcgagggggaggugggcgcgaucgcccuggacuucaagcccggcacguccgggagcccgaucgugaaccgcgagggcaagaucgucgggcuguacggcaacggcguggugaccaccuccgggaccuacgucagcgccaucgcccaggcgaaggccagccaggagggcccccuccccgagaucgaggacgagguguuccggaagcgcaaccugacgaucauggaccugcacccgggguccggcaagacccggcgcuaccuccccgccaucgugcgggaggccaucaagcgcaagcugcggacccugauccucgcccccacccgcgucguggcgagcgagauggccgaggcccugaaggggaugcccauccgcuaccagacgaccgccgugaaguccgagcacaccggcaaggagaucgucgaccugaugugccacgccaccuucacgaugcggcuccugagcccggugcgcgugcccaacuacaacaugaucaucauggacgaggcgcacuucaccgaccccuccagcaucgccgcccggggcuacaucuccacccgcgucgggaugggcgaggccgccgcgaucuucaugaccgccacgcccccggggagcguggaggccuucccccaguccaacgccgugauccaggacgaggagcgggacauccccgagcgcagcuggaacuccggcuacgaguggaucaccgacuuccccgggaagaccgucugguucgugccgagcaucaaguccggcaacgacaucgcgaacugccugcggaagaacggcaagcgcgugauccagcucagccggaagaccuucgacacggaguaccagaagaccaagaacaacgacugggacuacgucgugaccaccgacaucuccgagaugggggccaacuuccgcgccgaccgggugaucgacccccgccggugccugaagcccgucauccugaaggacggccccgagcgcgugauccucgccgggccgaugcccgucacgguggccagcgcggcccagcggcgcggccggaucgggcgcaaccacaacaaggagggcgaccaguacaucuacaugggccagccccugaacaacgacgaggaccacgcccacuggaccgaggccaagaugcugcucgacaacaucaacacccccgaggggaucaucccggcccuguucgagcccgagcgggagaaguccgcggccaucgacggcgaguaccgccugcgcggggaggcccggaagaccuucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggacgaaggagggcgagcggaagaagcugcgcccccgguggcuggacgcccgcaccuacagcgacccgcucgcgcugcgggaguucaaggaguucgccgccgggcgccgguccgugagcggcgaccugauccucgagaucgggaagcugccccagcaccugacccagcgcgcccagaacgcgcucgacaaccuggugaugcugcacaacuccgagcagggcggccgggccuaccgccacgccauggaggagcuccccgacaccaucgagacgcugauguuccuggcccucaucgccguccugaccgggggcgugacccuguucuuccucagcgggcggggccuggggaagaccuccaucggccugcucugcgugauggcgagcuccguccugcuguggauggccagcguggagccccacuggaucgccgccuccaucauccucgaguucuuccugauggugcugcucaucccggagcccgaccgccagcggacgccccaggacaaccagcuggccuacgucgugaucggccuccucuucaugauccugaccguggcggccaacgagauggggcugcucgagaccaccaagaaggaccugggcaucgggcacgucgccguggagaaccaccaccacgccgccaugcuggacguggaccuccacccggcgagcgccuggacccuguacgccgucgccacgaccaucaucacccccaugaugcgccacaccaucgagaacacgaccgccaacaucucccugaccgcgaucgccaaccaggccgccauccucaugggccuggacaagggguggcccaucagcaagauggacaucggcgugccccugcucgcgcugggcugcuacucccaggugaacccgcugacccucacggccgccguccugaugcugguggcccacuacgccaucaucgggcccggccuccaggcgaaggccacccgggaggcccagaagcgcaccgccgccgggaucaugaagaaccccaccguggacggcaucgucgcgaucgaccuggaccccgugguguacgacgccaaguucgagaagcagcuggggcagaucaugcuccugauccugugcacgagccagauccuccugaugcgcaccaccugggcccugugcgaguccaucacccucgccacgggcccgcugaccacccugugggagggcagccccgggaaguucuggaacaccacgaucgccgucuccauggcgaacaucuuccggggcagcuaccucgccggggccggccuggccuucucccugaugaagucccucggcgggggccgccgggggaccggcgcgcagggggagacccugggcgagaaguggaagcgccagcugaaccagcucagcaaguccgaguucaacaccuacaagcggagcggcaucauggagguggaccgcuccgaggccaaggaggggcugaagcggggcgagacgaccaagcacgccgugagccgcgggaccgccaagcugcggugguucgucgagcgcaaccucgugaagcccgagggcaaggugaucgaccuggggugcggccggggcgggugguccuacuacugcgccggccugaagaaggucaccgaggugaagggguacacgaagggcgggcccggccacgaggagccgauccccauggcgaccuacggcuggaaccuggugaagcuccacagcgggaaggacgucuucuucaucccgcccgagaagugcgacacccugcugugcgacaucggcgaguccagcccgaaccccaccaucgaggaggggcgcacgcuccgggugcugaagaugguggagcccuggcugcgcggcaaccaguucugcaucaagauccucaaccccuacaugccguccgucguggagacccuggagcagaugcagcggaagcacgggggcaugcuggugcgcaacccccucagccggaacuccacccacgagauguacugggucagcugcggcaccgggaacaucguguccgccgugaacaugacgagccgcaugcugcugaaccgguucaccauggcccaccgcaagcccaccuacgagcgcgacgucgaccucggcgccgggacccggcacguggccguggagcccgaggucgcgaaccuggacaucaucggccagcgcaucgagaacaucaagcacgagcacaaguccaccuggcacuacgacgaggacaacccguacaagacgugggccuaccacggcagcuacgaggugaagcccuccgggagcgccuccagcauggucaacggcguggugaagcugcucaccaagcccugggacgucauccccauggugacccagaucgccaugaccgacacgaccccguucgggcagcagcggguguucaaggagaaggucgacacccgcacccccaaggccaagcggggcacggcgcagaucauggaggugaccgccaaguggcuguggggguuccugagccgcaacaagaagccccggaucugcacccgcgaggaguucacccggaaggugcgcuccaacgccgccaucggcgcggucuucguggacgagaaccaguggaacagcgccaaggaggccguggaggacgagcgguucugggaccucguccaccgcgagcgggagcugcacaagcagggcaagugcgccacgugcguguacaacaugauggggaagcgcgagaagaagcugggcgaguucgggaaggccaagggcucccgggcgaucugguacauguggcucggggcccgcuuccuggaguucgaggcccugggcuucaugaacgaggaccacugguucagccgggagaacucccucagcggcguggagggggagggccugcacaagcugggguacauccuccgcgacaucuccaagaucccgggcgggaacauguacgccgacgacaccgccggcugggacacccggaucaccgaggacgaccugcagaacgaggcgaagaucacggacaucauggagcccgagcacgcccugcucgccaagagcaucuucaagcugaccuaccagaacaaggucgugcgcgugcagcggcccgccaagaacggcaccgucauggacgugaucucccgccgcgaccagcgggggagcggccagguggggaccuacggccugaacacguucaccaacauggaggcccagcucauccgccagauggaguccgagggcaucuucagccccuccgagcuggagaccccgaaccuggcggggcggguccucgacuggcuggagaagcacggcguggagcgccugaagcggauggccaucagcggggacgacugcguggucaagcccaucgacgaccgcuucgccgccgcccucaccgcgcugaacgacaugggcaaggugcggaaggacaucccccagugggagcccuccaagggguggaacgacuggcagcaggucccguucugcagccaccacuuccaccagcugaucaugaaggacggccgcgagaucgucgugcccugccggaaccaggacgagcucgugggccgcgcccgggucucccagggggccggcuggagccugcgcgagacggccugccugggcaagagcuacgcgcagauguggcagcucauguacuuccaccggcgcgaccugcggcuggccgccaacgccaucugcuccgccgugcccguggacuggguccccaccagccgcaccaccugguccauccacgcgcaccaccaguggaugacgaccgaggacaugcucagcguguggaaccggguguggaucgaggagaacccguggauggaggacaagacccacaucuccagcuggggcgacguccccuaccuggggaagcgcgaggaccaguggugcggcucccugaucggccucaccgcccgggccacgugggccaccaacauccagguggccaucaaccaggugcgccgccugaucgggaacgagaacuaccuggacuacaugaccagcaugaagcgguucaagaacgaguccgaccccgagggcgcgcucugguga

SEQ ID NO: 8704 - RNA, 9879 nt, Artificial Sequence
  derived and/or modified CDS sequence (opt1) from DENV-1__GU131814__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacgcucauccuggcccccacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccucaaggacgggcccgagcgcgugauccuggcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggucaugcuccacaacagcgagcagggcgggcgggccuaccgccacgccauggaggagcugcccgacaccaucgagacccugaugcuccuggcgcugaucgccgugcucaccggcggggugacccuguucuuccuguccggccgggggcucggcaagacgagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcggacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcacggggaacaucgugagcgccgucaacaugaccucccgcaugcuccugaaccgcuucaccauggcccaccggaagcccaccuacgagcgcgacguggaccugggcgcgggcacgcggcacguggccgucgagcccgagguggccaaccucgacaucaucgggcagcgcaucgagaacaucaagcacgagcacgagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgggucuucaaggagaagguggacacgcgcaccccgaaggccaagcggggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaagguggugcgcguccagcggcccgcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccaaccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgaccccgagggggcccugugguga

SEQ ID NO: 8705 - RNA, 9879 nt, Artificial Sequence
  derived and/or modified CDS sequence (opt1) from DENV-1__GU131815__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccaccgacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugacccgccuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccagcggggccagcacgucccaggagaccuggaaccgccaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccgccugaucaccgccaacccgaucgugaccgacaaggagaagcccgucaacaucgaggccgagccgcccuucggggagagcuacaucacgaucggcgccggcgagaaggcgcucaagcuguccugguucaagaaggggagcuccaucggcaagauguucgaggccaccgcccgcggggcccgccgcauggccauccugggcgacaccgcgugggacuucgggagcaucggcggcguguucaccuccguggggaagcucguccaccagaucuucggcacggccuacggggugcuguucagcggcguguccuggaccaugaagaucgggaucggcguccugcucaccuggcugggccugaacagccgguccaccagccucuccaugacgugcaucgccguggggcuggugacccuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccgucguggugggggacgucgccggcauccuggcgcaggggaagaagaugauccgcccccagcccauggaguacaaguacuccuggaaguccuggggcaaggccaagaucaucggcgccgacgugcagaacaccaccuucaucaucgacgggcccaacacgccggagugccccgacgaccagcgggccuggaacaucugggagguggaggacuacggcuucgggaucuucaccaccaacaucuggcugaagcuccgcgacuccuacacccaggucugcgaccaccggcugaugagcgcggccaucaaggacuccaaggccgugcacgccgacaugggcuacuggaucgagagcgagaagaacgagacguggaagcuggcccgcgcguccuucaucgaggugaagaccugcaucuggcccaagagccacacccucugguccaacggcguccuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgugguggucgacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgugaaggagaaggaggagaaccucgucaagagcaugguguccgccggcagcggcgagguggacagcuucucccuggggcugcucugcaucagcaucaugaucgaggaggucaugcgcucccgguggagccgcaagaugcugaugacgggcacccuggccguguucuuccuccugaucauggggcagcugaccuggaacgaccucauccgccugugcaucauggugggcgccaacgcguccgaccggauggggaugggcaccacguaccuggcccucauggccaccuucaagaugcgcccgauguucgccgucgggcugcuguuccggcgccucaccagccgggaggugcugcugcucaccaucgggcugucccugguggccagcgucgagcuccccaacucccuggaggagcugggcgacgggcucgcgaugggcaucaugauccugaagcugcucacggacuuccagagccaccagcugugggccacccugcucucccugaccuucaucaagaccacguucagccugcacuacgccuggaagaccauggccauggugcucuccaucgucagccuguucccccugugccucuccaccaccagccagaagacgaccuggcugcccgugcugcucggcucccuggggugcaagccgcugaccauguuccucaucgcggagaacaagaucuggggccgccggagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgcgacgacacccucacgauccugcugaaggcgacccuccuggccgccagcggcgucuacccgcuguccauccccgccacccucuucgugugguacuucuggcagaagaagaagcagcggagcggggugcugugggacacccccagcccgcccgaggucgagcgcgccgugcuggacgacggcaucuaccggaucaugcagcgcggccugcucgggcggagccaggugggcgucgggguguuccaggagaacguguuccacacgauguggcacgucacccgcggcgcggugcugauguaccaggggaagcggcuggagcccuccugggccagcgugaagaaggaccucaucuccuacggcggcggguggcgccugcagggcagcuggaacaccggggaggagguccaggugaucgccguggagcccggcaagaaccccaagaacguccagaccgcccccgggacguucaagacccccgagggcgaggugggcgccaucgcgcuggacuucaagcccgggaccuccggcagccccaucgugaaccgggaggggaagaucgucggccucuacggcaacgggguggugaccacguccggcaccuacgucagcgccaucgcccaggccaaggcgagccaggaggggccgcugcccgagaucgaggacgagguguuccgcaagcggaaccugaccaucauggaccuccaccccggcuccgggaagacccgccgguaccugccggccaucgugcgcgaggccaucaagcgcaagcugcggacgcucauccuggcccccacccgcgucguggccagcgagauggcggaggcccugaagggcaugcccauccgguaccagaccaccgccgugaaguccgagcacacgggcaaggagaucgucgaccucaugugccacgccaccuucaccaugcgccugcugagccccgugcgggugccgaacuacaacaugaucaucauggacgaggcccacuucaccgaccccuccagcgucgcggcccgcggguacaucuccacgcgggugggcaugggggaggccgccgccaucuucaugaccgcgacgccgcccggcagcguggaggccuucccgcaguccaacgccgucauccaggacgaggagcgcgacauccccgagcggagcuggaacuccggguacgaguggaucaccgacuuccccggcaagacggugugguucgugcccagcaucaaguccggcaacgacaucgccaacugccuccgcaagaacgggaagcgggucauccagcugagccgcaagaccuucgacaccgaguaccagaagaccaagaacaacgacugggacuacguggugacgaccgacaucuccgagaugggcgcgaacuuccgggccgaccgcgucaucgacccgcggcgcugccugaagcccgugauccucaaggacgggcccgagcgggugauccuggccggccccaugccggucaccguggccagcgccgcgcagcgccgggggcgcaucggccgcaaccacaacaaggagggcgaccaguacaucuacauggggcagccccugaacaacgacgaggaccacgcccacuggaccgaggccaagaugcuccuggacaacaucaacacgcccgagggcaucauccccgcccuguucgagccggagcgggagaaguccgccgcgaucgacggggaguaccgccuccggggcgaggcccgcaagaccuucgucgagcugaugcggcgcggggaccugcccguguggcucagcuacaagguggccuccgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacagcgacccccuggcccugcgcgaguucaaggaguucgcggccggccggcgcuccgugagcggggaccucauccuggagaucggcaagcugccgcagcaccucacgcagcgggcccagaacgcccuggacaaccuggucaugcuccacaacuccgagcagggcgggcgcgcguaccggcacgccauggaggagcugcccgacaccaucgagacccugaugcuccuggcccugaucgccgugcucaccggcggggugacccuguucuuccugagcggccgcgggcucggcaagacguccaucggccugcugugcgucauggccagcuccgugcuccuguggauggcgagcguggagccccacuggaucgccgccuccaucauccuggaguucuuccucaugguccugcugauccccgagccggaccggcagcgcacgccccaggacaaccagcucgccuacguggugaucgggcugcuguucaugauccucaccgucgccgcgaacgagaugggccugcuggagaccacgaagaaggaccucgggaucggccacguggccgccgagaaccaccaccacgccgccaugcuggacguggaccugcaccccgcgagcgccuggacccucuacgccgucgccaccaccaucaucacgccgaugaugcgccacaccaucgagaacaccaccgccaacaucucccugacggcgaucgccaaccaggccgccauccugauggggcucgacaagggcuggcccaucagcaagauggacaucggcgugccccugcuggcgcucgggugcuacucccaggugaacccccugacccugaccgccgccguccucaugcugguggcccacuacgccaucaucggcccggggcugcaggcgaaggccacccgggaggcccagaagcgcacggccgccggcaucaugaagaaccccaccguggacgggaucgucgcgaucgaccucgaccccgugguguacgacgccaaguucgagaagcagcugggccagaucaugcugcucauccugugcaccagccagauccugcucaugcggaccacgugggcccugugcgaguccaucacccuggccaccggcccccucaccacgcugugggaggggagcccgggcaaguucuggaacaccaccaucgccgucuccauggcgaacaucuuccgcgggagcuaccuggccggcgccggccucgccuucucccugaugaagucccucgggggcgggcggcgcgggaccggggcgcagggcgagacgcucggcgagaaguggaagcggcagcugaaccagcugagcaaguccgaguucaacaccuacaagcgcagcgggaucauggagguggaccgguccgaggccaaggagggccucaagcgcggggagaccaccaagcacgccgugagccggggcacggccaagcugcgcugguucgucgagcggaaccuggugaagcccgaggggaaggugaucgaccugggcugcggccgcgggggcugguccuacuacugcgccgggcucaagaaggucaccgaggugaagggcuacaccaagggcgggcccggccacgaggagcccaucccgauggcgaccuacggguggaaccuggugaagcugcacagcggcaaggacgucuucuucaucccgcccgagaagugcgacacgcuccugugcgacaucggggaguccagccccaacccgaccaucgaggagggccggacccugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggacgggcaacaucguguccgccgugaacaugaccagccgcaugcuccugaaccgguucaccauggcccaccgcaagcccaccuacgagcgggacgucgaccugggggccggcacgcgccacguggccguggagcccgaggucgcgaaccucgacaucaucggccagcggaucgagaacaucaagcacgagcacaaguccaccuggcacuacgacgaggacaaccccuacaagaccugggccuaccacgggagcuacgaggugaagccguccggcagcgccuccagcauggugaacggggucgugaagcugcugaccaagcccugggacgucauccccauggugacgcagaucgccaugaccgacaccacccccuucggccagcagcgcguguucaaggagaaggucgacacgcggaccccgaaggccaagcgcgggaccgcgcagaucauggaggugaccgccaaguggcucuggggcuuccugagccggaacaagaagccccgcaucugcacgcgggaggaguucacccgcaaggugcgguccaacgccgccaucggcgcggucuucguggacgagaaccaguggaacagcgccaaggaggccguggaggacgagcgcuucugggaccugguccaccgggagcgcgagcuccacaagcaggggaagugcgcgaccugcguguacaacaugaugggcaagcgggagaagaagcugggggaguucggcaaggccaaggggucccgcgcgaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacaccgccggcugggacacgcgcaucaccgaggacgaccuccagaacgaggcgcgcaucaccgacaucauggagccggagcacgcccugcuggccaagagcaucuucaagcucaccuaccagaacaaggucgugcgggugcagcgccccgccaagaacgggacggucauggacgugaucucccggcgcgaccagcggggcagcggccaggugggcaccuacggccugaacaccuucaccaacauggaggcccagcugauccgccagauggaguccgaggggaucuucagccccuccgagcucgagacgcccaaccuggcggagcggguccuggacuggcucgagaaguacggcguggagcgccugaagcggauggccaucagcggggacgacugcguggucaagccgaucgacgaccgcuucgccaccgcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcgcgggucucccagggggccggcuggagccuccgcgagaccgccugccugggcaagagcuacgcccagauguggcagcugauguacuuccaccggcgcgaccuccggcuggcggccaacgccaucugcuccgccgugcccguggacuggauccccacgagccgcaccaccugguccauccacgcccaccaccaguggaugaccacggaggacaugcugagcgucuggaaccgcguguggaucgaggagaaccccuggauggaggacaagacccacaucuccagcuggggcgacgugccguaccucgggaagcgggaggaccaguggugcggcucccugaucggccugaccgcgcgcgccaccugggccaccaacauccaggucgccaucaaccaggugcggcgccucaucgggaacgagaacuaccuggacuacaugacgagcaugaagcgguucaagaacgaguccgaccccgagggcgcccugugguga

SEQ ID NO: 8706 - RNA, 9879 nt, Artificial Sequence
  derived and/or modified CDS sequence (opt1) from DENV-1__GU131818__SS-prME
agcgugaccaugcugcucaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaagguggagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgucaugugcacggggagcuucaagcuggagaaggagguggcggagacccagcacggcaccgugcucguccagaucaaguacgagggcaccgacgcccccugcaagauccccuucuccacgcaggacgagaagggggugacccagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccacggcccgcggggcccgccggauggcgauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcuccugaccuggcugggccucaacagccgcuccaccagccuguccaugaccugcaucgccguggggcuggucacgcucuaccugggcgugauggugcaggccgacagcgggugcgucaucaacuggaagggccgcgagcugaagugcgggagcggcaucuucgugaccaacgaggugcacaccuggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucacggugguggucggggacguggcgggcauccuggcccaggggaagaagaugauccgcccccagcccauggaguacaaguacuccuggaaguccuggggcaaggccaagaucaucggcgccgacgugcagaacaccaccuucaucaucgacgggcccaacaccccggagugccccgacgaccagcgggcguggaacaucugggaggucgaggacuacggcuucgggaucuucacgaccaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagacgugcaucuggcccaagagccacacccugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcacgaccguggucguggacgagcacugcggcaaccgcgggccgagccugcggaccaccacggugaccggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacgcucgccguguucuuccugcugaucauggggcagcucaccuggaacgaccugauccgccugugcaucauggucggcgcgaacgccuccgaccggauggggaugggcaccaccuaccucgcccugauggccacguucaagaugcgcccgauguucgccguggggcuccuguuccgccggcugaccagccgcgaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacgcuccugucccugaccuucaucaagaccaccuucagccuccacuacgccuggaagacgauggcgaugguccuguccaucgugagccuguucccccucugccuguccaccaccagccagaagaccacguggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgcgacgacacccugaccauccugcucaaggccacgcugcuggccgugagcggcguguacccgcucuccauccccgccacccuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacaccauguggcacgugacgcgcggcgcgguccugauguaccaggggaagcggcucgagcccuccugggccagcgugaagaaggaccugaucuccuacggcggcggguggcgccugcagggcagcuggaacaccggggaggaggugcaggucaucgccguggagcccggcaagaaccccaagaacgugcagaccgcccccgggaccuucaagacguccgagggcgaggucggcgccaucgcgcucgacuucaagcccgggaccagcggcagccccaucgugaaccgggaggggaagaucgugggccuguacggcaacggggucgugaccaccuccggcacguacgugagcgccaucgcccaggccaaggcgucccaggaggggccccugccggagaucgaggacgaggucuuccgcaagcggaaccucaccaucauggaccugcaccccggcagcgggaagacccgccgguaccugcccgccaucgugcgcgaggccaucaagcggaagcuccgcacccugauccuggccccgacgcggguggucgccuccgagauggcggaggcccucaagggcaugcccauccgcuaccagaccaccgccgucaagagcgagcacaccggcaaggagaucguggaccugaugugccacgccacguucaccaugcgccugcucucccccguccgggugcccaacuacaacaugaucaucauggacgaggcccacuucaccgacccgagcuccaucgcggcccgcggguacaucagcacccgggugggcaugggggaggccgccgccaucuucaugacggcgacgccgcccggcuccgucgaggccuucccccagagcaacgccgugauccaggacgaggagcgcgacaucccggagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgcgaacuuccgggccgaccgcgugaucgacccccggcgcugccucaagccggugauccugaaggacgggcccgagcgggucauccuggccggccccaugcccgugaccgucgccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccggcugcgcggcgaggcccgcaagacguucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgcggccggccggcgcagcgucuccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacacgaucgagacccucaugcugcuggcccucaucgccgugcugaccggcggggucacccuguucuuccucuccggccgcgggcugggcaagaccagcaucggccugcucugcgugauggccuccagcgcgcugcuguggauggccuccguggagccccacuggaucgccgccagcaucauccucgaguucuuccugaugguccugcucauccccgagcccgaccggcagcgcacgccgcaggacaaccagcuggccuacguggugaucgggcuccucuucaugauccugaccgucgcggccaacgagaugggccugcucgagaccaccaagaaggaccuggggaucggccacguggccguggagaaccaccaccacgccgccaugcuggacgucgaccuccaccccgcguccgccuggacgcuguacgccguggccaccaccaucaucacccccaugaugcggcacacgaucgagaacaccaccgccaacaucagccugaccgcgaucgccaaccaggccgccauccucauggggcuggacaagggcuggccgaucuccaagauggacaucggcgugccccugcucgcgcuggggugcuacagccaggucaacccccugacgcucaccgccgccgugcugaugcugguggcccacuacgccaucaucggccccgggcuccaggcgaaggccacccgcgaggcccagaagcggaccgccgccggcaucaugaagaacccgacggucgacgggaucguggcgaucgaccuggaccccguggucuacgacgccaaguucgagaagcagcugggccagaucaugcuccuggugcugugcaccucccagauccuccugaugcgcaccaccugggcccugugcgagagcaucacgcucgccaccggcccccugaccacccugugggaggggucccccggcaaguucuggaacacgaccaucgccgugagcauggcgaacaucuuccgcgggagcuaccucgccggcgccucccuggccuucagccugaugaagucccucggcgggggccggcgcgggaccggcgcgcagggggagacccugggcgagaaguggaagcggcagcugaaccagcucagcaaguccgaguucaacacguacaagcgcagcggcaucauggaggucgaccgguccgaggccaaggaggggcugaagcgcggcgagaccaccaagcacgccgugagccgggggaccgccaagcugcgcugguucguggagcggaaccucgucaagccggagggcaaggugaucgaccuggggugcggccgcggcgggugguccuacuacugcgccggccugaagaaggugacggaggucaagggguacaccaagggcgggcccggccacgaggagcccauccccauggcgaccuacggcuggaaccuggugaagcuccacagcgggaaggacguguucuucaucccgcccgagaagugcgacacccugcugugcgacaucggcgaguccagccccaaccccacgaucgaggaggggcggacccuccgcguccugaagaugguggagccguggcugcggggcaaccaguucugcaucaagauccucaaccccuacaugcccuccguggucgagacccuggagcagaugcagcgcaagcacgggggcaugcuggugcggaacccccucagccgcaacuccacccacgagauguacugggugagcugcggcaccgggaacaucgucuccgccgugaacaugacgagccggaugcugcugaaccgcuucaccauggcccaccggaagccgaccuacgagcgcgacguggaccucggcgccgggacccgccacgucgccguggagcccgagguggcgaaccuggacaucaucggccagcggaucgagaacaucaagcacgagcacaaguccacguggcacuacgacgaggacaaccccuacaagaccugggccuaccacggcagcuacgaggucaagcccagcggguccgccagcuccauggugaacggcgucgugaagcugcucaccaagccgugggacgugauccccauggucacccagaucgccaugacggacaccacccccuucgggcagcagcgcguguucaaggagaagguggacacccggacgcccaaggccaagcgcggcaccgcgcagaucauggaggucaccgccaaguggcuguggggguuccugagccggaacaagaagccgcgcaucugcacccgggaggaguucacgcgcaaggugcgguccaacgccgccaucggcgcgguguucgucgacgagaaccaguggaacagcgccaaggaggccguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcucccgcgcgaucugguacauguggcucggggcccgguuccuggaguucgaggcccugggcuucaugaacgaggaccacugguucagccgcgagaacucccucagcggcguggagggggagggccugcacaagcugggguacauccuccgggacaucuccaagauccccggcgggaacauguacgccgacgacaccgccggcugggacacccgcaucacggaggacgaccugcagaacgaggcgaagaucaccgacaucauggagcccgagcacgcccugcucgccaagagcaucuucaagcugaccuaccagaacaaggugguccgggugcagcgcccggccaagaacggcaccgugauggacgucaucucccggcgcgaccagcgcgggagcggccagguggggacguacggccugaacaccuucaccaacauggaggcccagcucauccggcagauggaguccgaggagaucuucagccccuccgagcuggagacccccaaccuggcgggccgcgugcucgacuggcuggagaagcacggggucgagcggcugaagcgcauggccaucagcggcgacgacugcguggugaagcccaucgacgaccgguucgccacggcccucaccgcccugaacgacauggggaagguccgcaaggacaucccgcagugggagcccagcaagggcuggaacgacuggcagcagguccccuucugcucccaccacuuccaccagcugaucaugaaggacgggcgggagaucgugguccccugccgcaaccaggacgagcucgugggccgggcgcgcgugagccagggcgccggguggucccugaaggagaccgccugccugggcaagagcuacgcccagauguggcagcucauguacuuccaccggcgcgaccugcggcuggcggccaacgccaucugcuccgccgucccgguggacugggugcccaccagccgcacgaccugguccauccacgcccaccaccaguggaugaccaccgaggacaugcucagcgucuggaaccggguguggaucgaggagaaccccuggauggaggacaagacgcacaucuccagcuggggcgacgugcccuaccugggcaagcgcgaggaccaguggugcgggucccugaucggccucaccgcgcgggccaccugggccaccaacauccaggucgccaucaaccaggugcgccggcugaucggcaacgagaacuaccuggacuacaugaccagcaugaagcgcuucaagaacgaguccgacccggagggggcccucugguga

SEQ ID NO: 8707 - RNA, 9879 nt, Artificial Sequence
  derived and/or modified CDS sequence (opt1) from DENV-1__GU131820__SS-prME
agcgugaccaugcugcucaugcugaugcccaccgcccuggccuuccaccucaccacccggggcggggagccccacaugaucgugaccaagcaggagcgggggaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggccucggcgaggucgacagcuucucccuggggcugcucugcaucagcaucaugaucgaggaggugaugcgcucccgguggagccgcaagaugcugauggccggcacccuggccguguuccuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgacccucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcgugguguccauccugcugagcagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggacgaugaagaucaaggacgaggagcgggacgacacccugaccauccuccugaaggccacccugcucgccaucagcggcguguacccgcuguccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgcgaggggaagaucgugggccuguacggcaacggggucgugacgaccuccggcaccuacgugagcgccaucgcccaggccaaggcgagccaggaggggccgcuccccgagaucgaggacgaggucuuccggaagcgcaaccugaccaucauggaccugcaccccggcuccgggaagacgcggcgcuaccucccggccaucgugcgggaggccaucaagcgcaagcugcggacccugauccucgcccccacccgcguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccugaaggacgggcccgagcgcgucauccucgccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcgcggcgaggcccggaagaccuucguggagcucaugcgccgcggggaccugcccguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccaccaugcucgacguggaccugcaccccgccagcgccuggacccuguacgcgguggccacgaccaucaucaccccgaugaugcgccacaccaucgagaacacgaccgccaacaucucccucaccgccaucgccaaccaggcggccauccugauggggcuggacaagggcuggcccaucagcaagauggacaucggcgucccccuccuggcccuggggugcuacucccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgagccagauccugcugaugcgcaccaccugggcgcucugcgaguccaucacccuggccacgggcccccugaccacccucugggaggggagcccgggcaaguucuggaacaccacgaucgccguguccauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcugagcaaguccgaguucaacaucuacaagcggagcgggaucauggaggucgaccgcuccgaggccaaggagggccugaagcgcggggagaccacgcgccacgcggugagccggggcaccgccaagcugcgcugguucguggagcggaaccucgucaagcccgaggggaaggugaucgaccugggcugcggccgcgggggcugguccuacuacugcgccgggcugaagaaggugaccgaggucaagggcuacaccaagggcgggcccggccacgaggagcccaucccgauggccacguacggguggaaccucgugaagcugcacagcggcaaggacguguucuucacgccgcccgagcggugcgacacccugcucugcgacaucggggaguccagccccaacccgaccaucgaggagggccgcacgcugcggguccugaagaugguggagcccuggcuccgcgggaaccaguucugcaucaagauccugaaccccuacaugcccuccguggucgagacccuggagcagaugcagcggaagcacggcggcaugcucgugcgcaacccgcugagccggaacuccacccacgagauguacugggugagcugcgggaccggcaacaucgucuccgccgugaacaugaccagccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagacgugggccuaccacgggagcuacgaggucaagccguccggcagcgcguccagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcccgcuggcuguggggcuuccucagccggaacaagaagccccgcaucugcacccgggaggaguucacccgcaaggugcgguccaacgcggccaucggcgccguguucgucgacgagaaccaguggaacagcgccaaggaggcgguggaggacgagcgcuucugggaccuggugcagaaggagcgggagcugcacaagcaggggaagugcgccacgugcgucuacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacccggaucaccgaggacgaccugcagaacgaggccaagaucacggacaucauggagccggagcacgcccuccuggcgaccagcaucuucaagcugaccuaccagaacaaggugguccgcgugcagcgccccgccaagaacgggaccgugauggacgucaucucccggcgcgaccagcggggcagcggccaggugggcacguacggccucaacaccuucaccaacauggaggcccagcugauccgccagauggaguccgaggggaucuuccugcccagcgagcucgagacccccaaccuggccgagcgggugcuggacuggcucgagaagcacggcgucgagcgccugaagcggauggccaucuccggggacgacugcguggugaagccgaucgacgaccgcuucgcgacggcccugaccgcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggccggcuggucccuccgcgagaccgcgugccugggcaagagcuacgcccagauguggcagcugauguacuuccaccggcgcgaccuccggcuggccgccaacgcgaucugcagcgccguccccguggacugggugcccaccucccgcacgaccuggagcauccacgcccaccaccaguggaugaccaccgaggacaugcuguccgucuggaaccggguguggaucgaggagaaccccuggauggaggacaagacgcacgugagcuccuggggcgacgucccguaccucgggaagcgcgaggaccaguggugcggcagccugaucggccugaccgcccgcgccaccugggcguccaacauccagguggccaucaaccaggugcggcgccucaucgggaacgagaacuaccuggacuacaugaccagcaugaagcgguucaagaacgagggcgaccccgagggggcccugugguga

SEQ ID NO: 8708 - RNA, 9879 nt, Artificial Sequence
  derived and/or modified CDS sequence (opt1) from DENV-1__HM181970__SS-prME
agcgugaccaugcugcucaugcugaugcccaccgcccuggccuuccaccucaccacccgcggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcugauccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccgucguggugggggacgucgcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggccgucuucuuccuccugaucaugggccagcugacguggaacgaccucauccgccugugcaucauggugggggcgaacgccuucgaccgcaugggcaugggcaccaccuaccuggcccucauggccaccuucaagaugcggccgauguucgccguggggcugcuguuccgccggcucacgagccgcgagguccugcugcucaccaucggccugucccugguggcgagcguggagcuccccaacucccuggaggagcugggggacggccucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccguccugcucgggucccugggcugcaagccgcugacgauguuccucaucgccgagaacaagaucugggggcggaaguccuggccccugaacgagggcaucauggccguggggaucguguccauccugcucagcagccugcugaagaacgacgucccccucgccggcccccugaucgccggcgggaugcugaucgcgugcuacgugaucuccggcagcuccgccgaccucagccuggagaaggccgccgagguguccugggaggaggaggccgagcacagcggggcgucccacaacauccuggucgaggugcaggacgacggcaccaugaagaucaaggacgaggagcgcgacgacacccucaccauccugcugaaggccacccuccuggccgugagcggggucuacccgcuguccauccccgccacccucuucgugugguacuucuggcagaagaagaagcagcggagcggcgugcugugggacacccccagcccgcccgaggucgagcgcgccgugcuggacgacggcaucuaccggaucaugcagcgcgggcugcucggccggagccaggugggggucggcguguuccaggaggacguguuccacaccauguggcacgucacccgcggggcggugcugauguaccagggcaagcggcuggagcccuccugggccagcgugaagaaggaccucaucuccuacggcgggggcuggcgccugcgggggagcuggaacacgggcgaggagguccaggugaucgccguggagcccgggaagaaccccaagaacguccagaccgcccccggcaccuucaagacccccgagggcgaggugggggccaucgcgcuggacuucaagcccggcacguccgggagccccaucgugaaccgcgagggcaagaucgucggccucuacgggaacggcguggugaccaccuccgggaccuacgucagcgccaucgcccaggccaaggcgagccaggagggcccgcugcccgagaucgaggacgagguguuccggaagcgcaaccugacgaucauggaccuccaccccggguccggcaagacccggcgcuaccugccggccaucgugcgggaggccaucaagcgcaagcugcgcacccucauccuggcccccacccgggucguggccagcgagauggcggaggcccugaagggcaugcccauccgcuaccagacgaccgccgugaaguccgagcacaccgggaaggagaucgucgaccucaugugccacgccaccuucacgaugcggcugcugagccccgugcgcgugccgaacuacaacaugaucaucauggacgaggcccacuucaccgaccccuccagcaucgcggcccggggcuacaucuccacccgcgucgggaugggcgaggccgccgccaucuucaugaccgcgacgccgcccgggagcguggaggccuucccgcaguccaacgccgugauccaggacgaggagcgggacauccccgagcgcagcuggaacuccggccacgaguggaucaccgacuuccccggcaagaccgucugguucgugcccagcaucaaguccgggaacgacaucgccaacugccuccggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccugaagcccgucauccucaaggacggccccgagcgcgugauccuggccgggcccaugccggugacggucgccagcgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgguggacggcgaguaccggcuccgcggggaggcccggaagaccuucgucgagcugaugcgccggggcgaccugcccguguggcucagcuacaagguggccuccgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgugagcggcgaccucauccuggagaucggcaagcugccgcagcaccucacccagcgcgcccagaacgcccuggacaaccuggucaugcuccacaacuccgagcagggcgggcgggcguaccgccacgccauggaggagcugcccgacaccaucgagacgcugaugcuccuggcccugaucgccgugcucaccgggggcgugacccuguucuuccugagcgggcggggccucggcaagaccuccaucgggcugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccaccaagaaggaccucggcaucgggcacguggccguggagaaccaccaccacgccgccaugcuggacgucgaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggugccccugcuggcccucggcugcuacucccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgagccagauccugcucaugcgcaccaccugggcccugugcgaguccaucacccuggccacggggccccucaccacccugugggagggcagcccggggaaguucuggaacaccacgaucgccguguccauggccaacaucuuccggggcagcuaccuggcgggcgccgggcucgccuucucccugaugaagucccugggcgggggccgccgggggaccggcgcccagggcgagacccucggggagaaguggaagcgccagcugaaccagcugagcaaguccgaguucaacaccuacaagcggagcggcaucauggagguggaccgcuccgaggcgaaggaggggcucaagcggggcgagacgaccaagcacgccgucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagcccaucccgauggccaccuacggcuggaaccuggucaagcugcacagcgggaaggacguguucuucaucccgcccgagaagugcgacacccuccugugcgacaucggcgaguccagccccaacccgaccaucgaggaggggcgcacgcugcgggugcucaagauggucgagcccuggcugcgcggcaaccaguucugcaucaagauccugaaccccuacaugcccuccgugguggagacccucgagcagaugcagcggaagcacggcgggaugcugguccgcaacccgcugagccggaacuccacccacgagauguacugggugagcugcggcaccgggaacaucguguccgcggucaacaugaccagccgcaugcuccugaaccgcuucacgauggcccaccggaagcccaccuacgagcgcgacguggaccugggcaccggcacccggcacguggccgucgagcccgagguggccaaccucgacaucaucgggcagcgcaucgagaacaucaagcacgagcacaaguccacguggcacuacgacgaggacaaccccuacaagaccugggccuaccacggcagcuacgaggugaagccguccgggagcgcguccagcauggucaacggcguggucaagcugcugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcccgcuggcucuggggcuuccugagccggaacaagaagccccgcaucugcacccgggaggaguucacgcgcaagguccgguccaacgcggccaucggggccguguucguggacgagaaccaguggaacagcgccaaggaggcggucgaggacgagcgcuucugggaccuggugcaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacucccugagcggcgucgagggggagggccuccacaagcugggguacauccugcgggacaucuccaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaagguggugcgcguccagcggcccgccaagaacggcaccgugauggacgugaucagccgccgggaccagcgcggguccggccaggucggcacguacgggcugaacaccuucaccaacauggaggcccagcugauccggcagauggagagcgagggcaucuucucccccagcgagcucgagacccccaaccuggccgagcgcgcgcuggacuggcucgagaaguacgggguggagcggcugaagcgcauggccaucuccggcgacgacugcguggucaagccgaucgacgaccgguucgccacggcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcgcgcgucagccagggcgccggguggucccuccgggagaccgccugccugggcaagagcuacgcccagauguggcagcugauguacuuccaccgccgggaccuccgccuggcggccaacgccaucugcagcgccgugcccguggacuggguccccaccucccggacgaccuggagcauccacgcccaccaccaguggaugaccaccgaggacaugcuguccguguggaaccgcguguggaucgaggagaaccccuggauggaggacaagacgcacaucagcuccugggaggacgucccguaccucgggaagcgcgaggaccaguggugcggcagccugaucggccugaccgcgcgggccaccugggccaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8709 - RNA, 9879 nt, Artificial Sequence
  derived and/or modified CDS sequence (opt1) from DENV-1__GU131821__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagaaggucgagaccugggcccugcggcaccccggguucacggugaucgcccucuuccuggcgcacgccaucggcaccagcaucacccagaaggggaucaucuucauccugcucaugcuggugacccccuccauggccaugcgcugcgucggcaucggcagccgggacuucguggaggggcuguccggcgccacguggguggacgucgugcucgagcacgggagcugcgugaccaccauggccaaggacaagcccacccuggacaucgagcugcucaagacggaggucaccaaccccgcggugcugcgcaagcugugcaucgaggccaagaucuccaacaccaccacggacagccggugcccgacccagggcgaggccacccucguggaggagcaggacgccaacuucgucugccgccggaccuucguggaccgcggcugggggaacggcugcgggcuguucggcaaggggucccugaucacgugcgccaaguucaagugcgugaccaagcucgagggcaagaccguccagcacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccgcaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccggcugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccgccugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccgccggauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgcgagcugaagugcgggagcggcaucuucgugacgaacgaggugcacaccuggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaaguucaccgugguggucggggacguggcgggcauccuggcccaggggaagaagaugauccgcccccagcccauggaguacaaguacuccuggaaguccuggggcaaggccaagaucaucggcgccgacgugcagaacacgaccuucaucaucgacgggcccaacaccccggagugccccgacgaccagcgggcguggaacaucugggaggucgaggacuacggcuucgggaucuucaccacgaacaucuggcucaagcugcgcgacuccuacacccaggugugcgaccaccggcugaugagcgccgccaucaaggacuccaaggccgugcacgccgacaugggcuacuggaucgagagcgagaagaacgagaccuggaagcucgcgcgcgccuccuucaucgaggucaagaccugcaucuggcccaagagccacacgcugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcaccacgguggucguggacgagcacugcggcaaccgcgggccgagccugcggaccaccaccgugacgggcaagaucauccacgaguggugcugccgcuccugcacccugccgccccugcgguucaagggggaggacggcugcugguacgggauggagauccgccccgucaaggagaaggaggagaaccuggucaagagcauggugagcgccggcuccggcgaggucgacagcuucucccuggggcuccugugcaucagcaucaugaucgaggaggugaugcggucccgcuggagccggaagaugcugaugaccggcacccucgccguguucuuccugcugaucauggggcagcucacguggaacgaccugauccgccugugcaucauggucggcgcgaacgccuccgaccggauggggaugggcaccaccuaccucgcccugauggccaccuucaagaugcgcccgauguucgccguggggcuccuguuccgccggcugacgagccgcgaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgcgacgacacccugaccauccugcucaaggccacccugcuggccgugagcggcguguacccgcucuccauccccgccacgcuguucgucugguacuucuggcagaagaagaagcagcggagcggggugcugugggacacccccagcccgcccgagguggagcgcgccguccucgacgacggcaucuaccggaucaugcagcgcggccugcuggggcggagccaggugggcgugggggucuuccaggagaacguguuccacaccauguggcacgugacccgcggcgcgguccugauguaccaggggaagcggcucgagcccuccugggccagcgugaagaaggaccugaucuccuacggcggcggguggcgccugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgggaggggaagaucgugggccuguacggcaacggggucgugaccaccuccggcaccuacgugagcgccaucgcccaggccaaggcgucccaggaggggccccugccggagaucgaggacgaggucuuccgcaagcggaaccucacgaucauggaccugcaccccggcagcgggaagacccgccgguaccugcccgccaucgugcgcgaggccaucaagcggaagcuccgcacccugauccuggccccgacccggguggucgccuccgagauggcggaggcccucaagggcaugcccauccgcuaccagacgaccgccgucaagagcgagcacaccggcaaggagaucguggaccugaugugccacgccaccuucacgaugcgccugcucucccccguccgggugcccaacuacaacaugaucaucauggacgaggcccacuucaccgacccgagcuccaucgcggcccgcggguacaucagcacccgggugggcaugggggaggccgccgccaucuucaugaccgcgacgccgcccggcuccgucgaggccuucccccagagcaacgccgugauccaggacgaggagcgcgacaucccggagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccccggcgcugccucaagccggugauccugaaggacgggcccgagcgggucauccuggccggccccaugcccgugacggucgccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccggcugcgcggcgaggcccgcaagaccuucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggacgaaggagggggagcgcaagaagcuccggccccgcuggcuggacgcccggaccuacuccgacccccuggcccuccgcgaguucaaggaguucgcggccggccggcgcagcgucuccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacgcucaugcugcuggcccucaucgccgugcugaccggcggggucacccuguucuuccucuccggccgcgggcugggcaagaccagcaucggccugcucugcgugauggccuccagcgcgcugcuguggauggccuccguggagccccacuggaucgccgccagcaucauccucgaguucuuccugaugguccugcucauccccgagcccgaccggcagcgcaccccgcaggacaaccagcuggccuacguggugaucgggcuccucuucaugauccugacggucgcggccaacgagaugggccugcucgagaccaccaagaaggaccuggggaucggccacguggccguggagaaccaccaccacgccaccaugcuggacgucgaccuccaccccgccuccgcguggacgcuguacgccguggccaccaccaucaucacccccaugaugcggcacacgaucgagaacaccaccgccaacaucagccugaccgccaucgcgaaccaggccgccauccucauggggcuggacaagggcuggccgaucuccaagauggacaucggcgugccccugcucgcccuggggugcuacagccaggucaacccccugacgcucaccgcggccgugcugaugcugguggcccacuacgccaucaucggccccgggcuccaggccaaggcgacccgcgaggcccagaagcggaccgccgccggcaucaugaagaacccgacggucgacgggaucguggccaucgaccuggaccccguggucuacgacgcgaaguucgagaagcagcugggccagaucaugcuccugauccugugcaccucccagauccuccugaugcgcaccaccugggcccugugcgagagcaucacgcucgccaccggcccccugaccacccugugggaggggucccccggcaaguucuggaacacgaccaucgccgugagcauggccaacaucuuccgcgggagcuaccucgcgggcgccggccuggccuucucccugaugaagucccucgggggcgggcggcgcggcaccggggcccagggcgagacccugggcgagaaguggaagcggcagcugaaccagcucuccaagagcgaguucaacacguacaagcgcuccgggaucauggagguggaccggagcgaggcgaaggagggccugaagcgcggggagaccaccaagcacgccgucucccggggcaccgccaagcugcgcugguucguggagcggaaccucgugaagccggaggggaaggucaucgaccugggcugcggccgcgggggcuggagcuacuacugcgccgggcugaagaaggugacggaggugaagggcuacaccaagggcgggcccggccacgaggagcccauccccauggccaccuacggguggaaccuggucaagcuccacuccggcaaggacguguucuucaucccgcccgagaagugcgacacccugcugugcgacaucggggagagcucccccaaccccacgaucgaggagggccggacccuccgcgugcugaagauggucgagccguggcugcgggggaaccaguucugcaucaagauccucaaccccuacaugcccagcgugguggagacccuggagcagaugcagcgcaagcacggcggcaugcugguccggaacccccucucccgcaacagcacccacgagauguacuggguguccugcgggaccggcaacaucgugagcgcggucaacaugacgucccggaugcugcugaaccgcuucaccauggcccaccggaagccgaccuacgagcgcgacguggaccucggggccggcacccgccacguggccgucgagcccgagguggccaaccuggacaucaucggccagcggaucgagaacaucaagcacgagcacaagagcacguggcacuacgacgaggacaaccccuacaagaccugggcguaccacggguccuacgaggugaagcccagcggcagcgccuccagcauggucaacgggguggucaagcugcucaccaagccgugggacgugauccccauggugacccagaucgccaugacggacaccacccccuucggccagcagcgcgucuucaaggagaagguggacacccggacgcccaaggccaagcgcgggaccgcccagaucauggaggugaccgcgaaguggcuguggggcuuccugucccggaacaagaagccgcgcaucugcacccgggaggaguucacgcgcaagguccggagcaacgccgccaucggcgccguguucguggacgagaaccaguggaacuccgcgaaggaggccgucgaggacgagcgcuucugggaccucgugcaccgggagcgcgagcugcacaagcaggggaagugcgcgaccugcguguacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgccggcugggacacccgcaucacggaggacgaccugcagaacgaggccaagaucaccgacaucauggagcccgagcacgcgcugcucgccaaguccaucuucaagcugaccuaccagaacaagguggugcggguccagcgcccggccaagaacgggaccgugauggacgugaucagccggcgcgaccagcgcggcuccgggcaggucggcacguacggccugaacaccuucaccaacauggaggcccagcucauccggcagauggagagcgaggggaucuucucccccagcgagcuggagacccccaaccuggccggccgcgugcucgacuggcuggagaagcacgggguggagcggcugaagcgcauggcgaucuccggcgacgacugcgucgugaagcccaucgacgaccgguucgccacggcccucaccgcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcccgcgugucccagggcgcgggguggagccugcgggagaccgccugccugggcaaguccuacgcccagauguggcagcucauguacuuccaccgccgggaccugcgccuggccgcgaacgccaucugcagcgccgugccggucgagugggugcccaccucccggacgaccuggagcauccacgcccaccaccaguggaugaccaccgaggacaugcucuccguguggaaccgcgucuggaucgaggagaaccccuggauggaggacaagacgcacaucagcuccuggggcgacgugcccuaccugggcaagcgggaggaccaguggugcggcagccugaucgggcucaccgcccgcgcgaccugggccaccaacauccagguggccaucaaccagguccggcgccugaucggcaacgagaacuaccuggacuacaugaccuccaugaagcgcuucaagaacgagagcgacccggagggggcccucugguga

SEQ ID NO: 8710 - RNA, 9879 nt, Artificial Sequence
  derived and/or modified CDS sequence (opt1) from DENV-1__JF937617__SS-prME
agcgugaccaugcugcucaugcugaugcccaccgcccuggccuuccaccucaccacccggggcggggagccccacaugguggugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccuguucuccggcgucagcuggaccaugaagaucgggcugggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacgugauguggaagcagaucuccaacgagcugaaccacauccugcucgagaacgacaugaaguucaccguggucgugggggacguggcgggcauccuggcccaggggaagaagaugauccggccccagcccauggaguacaaguacagcuggaaguccuggggcaaggccaagaucaugggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggucguguuccuccugcugaucauggggcagcucacguggaacgaccugauccgccugugcaucauggugggcgccaacgcgagcgaccgcauggggaugggcaccaccuaccucgcccugauggccaccuucaagaugcggccgauguucgccgucgggcuccuguuccgccggcugacgucccgcgaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccauggugcugagcaucgucucccuguucccccucugccugagcacgaccucccagaagaccaccuggcugcccgugcuccugggcagccuggggugcaagccgcucacgauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggaccaugaagaucaaggacgaggagcgggacgacacccugaccauccugcucaaggcgacccugcuggccgucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacacgggggaggagguccaggugaucgccgucgagcccggcaagaaccccaagaacgugcagaccgcccccgggaccuucaagacccccgagggcgagaucggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccgcacccugauccuggcccccacccgggucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgcggccgucgggaaccaccaccacgccgccaugcuggacguggaccuccaccccgccuccgcguggacccuguacgccguggccacgaccaucaucaccccgaugaugcgccacaccaucgagaacacgaccgccaacaucagccugaccgccaucgcgaaccaggccgccauccucaugggccuggacaagggcuggcccaucuccaagauggacaucggggucccccugcucgcccugggcugcuacagccaggugaacccccugacccucacggcggccgugcugaugcuggucgcccacuacgccaucaucgggccgggccuccaggccaaggcgacccgcgaggcccagaagcggaccgccgccgggaucaugaagaaccccaccguggacggcaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgugagcauggccaacaucuuccggggcuccuaccucgcgggcgccgggcuggccuucagccugaugaagucccucggcgggggccgccgggggaccggcgcccagggcgagacccugggggagaaguggaagcgccagcugaaccagcucuccaagagcgaguucaacaccuacaagcgguccggcaucauggaggucgaccgcagcgaggcgaaggaggggcugaagcggggcgagacgaccaagcacgccgugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacacgaagggcggccccgggcacgaggagcccaucccgauggccaccuacggcuggaaccuggugaagcuccacuccgggaaggacguguucuucaucccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgcggugaacaugaccucccgcaugcugcugaaccgcuucacgauggcccaccggaagcccaccuacgagcgcgacguggaccucggcgccggcacccggcacgucgccguggagcccgagguggccaaccuggacaucaucgggcagcgcaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgaaguggcuguggggcuuccugucccgcaacaagaagccccggaucugcacccgcgaggaguucacccggaaggugcgcagcaacgccgccaucggggccguguucgucgacgagaaccaguggaacuccgcgaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggccaucugguacauguggcucggcgcgcgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcccgcaucacggacaucauggagccggagcacgcgcugcucgccaaguccaucuucaagcugaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccaaccuggccgagcgcgugcucgacuggcuggagaaguacggggucgagcggcugaagcgcauggcgaucuccggcgacgacugcguggugaagccgaucgacgaccgguucgccaccgcccucacggcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgcgggguggagccugcgggagaccgccugccugggcaaguccuacgcccagauguggcagcucauguacuuccaccgccgggaccugcgccuggccgcgaacgccaucugcagcgccguccccguggacuggauccccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucacggcccgggcgaccugggccaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8711 - RNA, 9879 nt, Artificial Sequence
  derived and/or modified CDS sequence (opt1) from DENV-1__JF937618__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaacccccgcaacgugcagaccacccccgggacguucaagacccccgagggcgaggugggcgccaucgcccuggacuucaagcccgggaccagcggcucccccaucgucaaccgggaggggaagaucgugggccucuacggcaacgggguggucaccacgagcggcaccuacgugagcgccaucgcgcaggccaaggccucccaggaggggccgcugcccgagaucgaggacgagguguuccgcaagcggaaccugaccaucauggaccuccaccccggcagcgggaagacccgccgguaccugccggccaucguccgcgaggcgaucaagcgcaagcugcggacgcucauccuggcccccacccgcgugguggccuccgagauggccgaggcccugaagggcaugcccauccgguaccagaccaccgcggucaagagcgagcacacgggcaaggagaucguggaccucaugugccacgccaccuucaccaugcgccugcugucccccgugcgggucccgaacuacaacaugaucaucauggacgaggcccacuucaccgaccccagcuccaucgccgcccgcggguacaucagcacgcgggugggcaugggggaggcggccgccaucuucaugaccgccacgccgcccggcuccguggaggccuucccgcagagcaacgcggucauccaggacgaggagcgcgacauccccgagcgguccuggaacagcggguacgaguggaucaccgacuuccccggcaagacggugugguucgugcccuccaucaagagcggcaacgacaucgccaacugccuccgcaagaacgggaagcgggucauccagcugucccgcaagaccuucgacaccgaguaccagaagaccaagaacaacgacugggacuacguggugacgaccgacaucagcgagaugggcgccaacuuccgggccgaccgcgucaucgacccgcggcgcugccugaagcccgugauccucaaggacgggcccgagcgggugauccuggcgggccccaugccggucaccguggccuccgccgcccagcgccgggggcgcaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgggagaaguccgccgccaucgacggggaguaccgccuccggggcgaggcccgcaagaccuucgucgagcugaugcggcgcggggaccugcccguguggcucuccuacaagguggcgagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacuccgacccccuggcccugcgcgaguucaaggaguucgccgccggccggcgcagcguguccggggaccucauccuggagaucggcaagcugccgcagcaccucacgcagcgggcgcagaacgcccuggacaaccuggucaugcuccacaacagcgagcagggcgggcgcgccuaccggcacgccauggaggagcugcccgacaccaucgagacccugaugcuccuggcgcugaucgccgugcucaccggcggggugacccuguucuuccuguccggccgcgggcucggcaagacgagcaucggccugcugugcgucauggccuccagcgugcuccuguggaccgccuccguggagccccacuggaucgccgcgagcaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagacgaccaagaaggaccucgggaucggccacguggccguggggaaccaccaccacgcggccaugcuggacgucgaccugcaccccgccuccgccuggacccucuacgccguggcgaccacgaucaucaccccgaugaugcgccacaccaucgagaacaccacggccaacaucagccugaccgccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacgcgggaggcccagaagcgcaccgcggccgggaucaugaagaaccccaccgucgacggcaucguggccaucgaccucgaccccguggucuacgacgccaaguucgagaagcagcugggccagaucaugcugcucauccugugcaccucccagauccugcucaugcggacgaccugggcccugugcgagagcaucacccuggcgaccgggccccucacgacccugugggagggcuccccggggaaguucuggaacaccaccaucgccgugagcauggccaacaucuuccgcggcuccuaccuggccggcgccgggcucgcguucagccugaugaagucccugggcgggggccggcgcgggacgggcgcccagggcgagacccucggggagaaguggaagcggcagcugaaccagcuguccaagagcgaguucaacaccuacaagcgcuccggcaucauggagguggaccggagcgaggccaaggaggggcucaagcgcggcgagaccacgaagcacgccgucucccgggggaccgcgaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccacguacggcuggaaccuggucaagcugcacuccgggaaggacguguucuucaucccgcccgagaagugcgacacccuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacgcacgagauguacuggguguccugcggcaccgggaacaucgugagcgccgucaacaugaccucccgcaugcuccugaaccgguucaccauggcccaccgcaagcccacguacgagcgggacguggaccugggcgcgggcacccgccacguggccgucgagcccgagguggccaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugacgaagcccugggacgugauccccauggugacccagaucgcgaugaccgacaccacgcccuucgggcagcagcgcgucuucaaggagaagguggacacccggaccccgaaggccaagcgcggcaccgcccagaucauggaggugacggccaaguggcucuggggcuuccugucccggaacaagaagccccgcaucugcacccgggaggaguucacccgcaagguccggagcaacgccgcgaucggggccguguucguggacgagaaccaguggaacuccgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgcggacgacacggccgggugggacacccgcaucaccgaggacgaccuccagaacgaggcccgcaucaccgacaucauggagccggagcacgcccugcuggccaaguccaucuucaagcucacguaccagaacaagguggugcggguccagcgccccgcgaagaacggcaccgugauggacgugaucagccggcgcgaccagcggggguccggccaggucggcaccuacgggcugaacaccuucacgaacauggaggcccagcugauccgccagauggagagcgagggcaucuucucccccagcgagcucgagacccccaaccuggccgagcgggugcuggacuggcucgagaaguacgggguggagcgccugaagcggauggccaucuccggcgacgacugcgucgugaagccgaucgacgaccgcuucgccaccgcgcugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgccggguggagccuccgcgagacggccugccugggcaaguccuacgcgcagauguggcagcugauguacuuccaccggcgcgaccuccggcuggccgccaacgccaucugcagcgcggugcccgucgacuggauccccaccucccgcaccaccuggagcauccacgcccaccaccaguggaugacgaccgaggacaugcuguccguguggaaccgcguguggaucgaggagaaccccuggauggaggacaagacccacaucagcuccuggggcgacgucccguaccucggcaagcgggaggaccaguggugcggcagccugaucgggcugaccgcccgcgccaccugggccacgaacauccagguggcgaucaaccaggugcggcgccucaucggcaacgagaacuaccuggacuacaugaccuccaugaagcgguucaagaacgagagcgaccccgagggggcccugugguga

SEQ ID NO: 8712 - RNA, 9879 nt, Artificial Sequence
  derived and/or modified CDS sequence (opt1) from DENV-1__JF937619__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgggagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggugcaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugaaguccauggucagcgccggcuccggcgagguggacagcuucucccuggggcugcucugcaucagcaucaugaucgaggaggugaugcggucccgcuggagccggaagaugcugaugaccggcacccuggccgucuucuuccuccugaucauggggcagcugaccuggaacgaccucauccgccugugcaucauggugggcgccaacgcguccgaccgcauggggaugggcacgaccuaccuggcccucauggugaccuucaagaugcggccgauguucgccgucggccugcuguuccgccggcucaccagccgcgaggugcugcugcucacgaucgggcugucccuggucgccagcguggagcuccccaacucccuggaggagcugggcgacgggcucgccaugggcaucaugauccugaagcugcucaccgacuuccagagcuaccagcugugggcgacccugcucucccugaccuucaucaagacgaccuucagccugcacuacgccuggaagaccauggccauggugcucuccaucgucagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgcgacgacacccucaccauccugcugaaggccacccuccuggcggucagcggcguguacccgcuguccauccccgccacccucuucguguggcacuucuggcagaagaagaagcagcggagcgggguccugugggacacgcccagcccgcccgagguggagcgcgccgugcuggacgacggcaucuaccggaucaugcagcgcggccugcucgggcggagccaggucggcguggggguguuccaggagaacgucuuccacaccauguggcacgugacccgcggcgccgugcugauguaccaggggaagcggcuggagcccuccugggccagcgucaagaaggaccucaucuccuacggcggcggguggcgcuuccagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgggaggggaagaucgugggccuguacggcaacgggguggucacgaccagcggcaccuacguguccgccaucgcgcaggccaaggccagccaggaggggccgcuccccgagaucgaggacgagguguuccgcaagcggaaccugaccaucauggaccugcaccccggcuccgggaagacgcgccgguaccucccggccaucguccgcgaggcgaucaagcggaagcugcgcacccugauccucgcccccacccgcgugguggccagcgagauggccgaggcccugaagggcaugcccauccgguaccagaccacggcggucaaguccgagcacaccggcaaggagaucguggaccugaugugccacgccaccuucaccaugcgccuccugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcauggaggccuucccgcaguccaacgcggugauccaggacgaggagcgcgacauccccgagcggagcuggaacuccggguacgaguggaucacggacuuccccggcaagaccgucugguucgugcccagcaucaaggccggcaacgacaucgccaacugccugcgcaagaacgggaagcgggugauccagcucucccgcaagaccuucgacaccgaguaccagaagaagaagaacaacgacugggacuacgucgugacgaccgacaucagcgagaugggcgccaacuuccgggcggaccgcgugaucgacccgcggcgcugccugaagcccgucauccugaaggacgggcccgagcgggugauccucgccggccccaugccggucaccguggccuccgccgcccagcgccgggggcgcaucggccggaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgcgagaaguccgccgccaucgacggggaguaccgccugcggggcgaggcgcgcaagaccuucguggagcucaugcggcgcggggaccugcccgucuggcuguccuacaagguggccagcgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggaccuacuccgacccccucgcccugcgcgaguucaaggaguucgccgcgggccggcgcagcguguccggggaccugauccucgagaucggcaagcugccgcagcaccugacgcagcgggcccagaacgcccucgacaaccuggugaugcugcacaacagcgagcagggcgggcgcgccuaccggcacgcgauggaggagcuccccgacaccaucgagacccugaugcugcucgcccugaucgccguccugaccggcggggugacccuguucuuccuguccggcaaggggcugggcaagaccagcaucggccuccugugcgugauggccuccagcguccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccacgaagaaggaccuggggaucggccacgucgcgguggagaaccaccaccacgccgccaugcucgacguggaccugcaccccgccuccgccuggacccuguacgcggucgccaccaccaucaucacgccgaugaugcgccacaccaucgagaacaccaccgccaacaucagccucacggccaucgccaaccaggcggccauccugauggggcuggacaagggcuggcccaucuccaagauggacaucggcgugccccuccuggcccuggggugcuacagccaggugaacccccucacccugaccgccgcgguccugaugcucguggcccacuacgccaucaucggcccggggcugcaggccaaggccacccgggaggcgcagaagcgcacggccgccggcaucaugaagaaccccaccaucgacgggaucguggccaucgaccuggaccccgucaucuacgacgccaaguucgagaagcagcucggccagaucaugcugcugauccucugcaccucccagauccugcugaugcgcaccacgugggcgcucugcgagagcaucacccuggccaccggcccccugaccacgcucugggagggguccccgggcaaguucuggaacaccaccaucgccgugagcauggccaacaucuuccggggguccuaccuggccggcgcgggccuggccuucagccucaugaagucccucgggggcgggcgccgggggaccggggcccagggcgagacgcugggcgagaaguggaagcgccagcucaaccagcuguccaagagcgaguucaacaccuacaagcgguccgggaucauggagguggaccgcagcgaggccaaggagggccugaagcgcggggagaccaccaagcacgcggucucccgcggcacggccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggccaccuacggguggaaccucgucaagcugcacuccggcaaggacguguucuucaucccgcccgagaagugcgacacgcugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacgcacgagauguacuggguguccugcgggaccggcaacaucgugagcgccgucaacaugaccucccgcaugcugcucaaccgguucaccauggcgcaccgcaagcccaccuacgagcgcgacguggaccugggggccggcacgcggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggugaagccgagcggcuccgcgagcagcauggucaacgggguggucaagcuccugaccaagcccugggacgugauccccauggugacgcagaucgccaugaccgacaccacccccuucggccagcagcgggucuucaaggagaagguggacacgcgcaccccgaaggccaagcgggggaccgcccagaucauggaggugaccgcccgcuggcuguggggcuuccucucccggaacaagaagccccgcaucugcacgcgggaggaguucacccgcaagguccggagcaacgcggccaucggcgccguguucguggacgagaaccaguggaacuccgccaaggaggcggucgaggacgaccgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacgcgcaucaccgaggacgaccugcagaacgaggccaagaucaccgacaucauggagccggagcacgcccuccuggcgaaguccaucuucaagcugaccuaccagaacaagguggugcggguccagcgccccgccaagaacgggacggugauggacgugaucagccgccgggaccagcgcggcuccgggcaggucggcaccuacggccucaacaccuucaccaacauggaggcccagcugauccggcagauggagagcgaggggaucuuccugcccaacgagcucgagacgcccaaccuggccggccgcgugcuggacuggcucgagaaguacgggguggagcggcugaagcgcauggccaucuccggcgacgacugcgucgugaagccgaucgacgaccgguucgcgaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggucccuccgggagaccgcgugccugggcaagagcuacgcccagauguggcagcugauguacuuccaccgccgggaccuccgccuggccgccaacgcgaucugcagcgccgugcccgucgacugggugcccacgucccggaccaccuggagcauccacgcccaccaccaguggaugaccacggaggacaugcuguccguguggaaccgcgucuggaucgaggagaaccccuggauggaggacaagacccggaucagcuccugggaggacgugccguaccucgggaagcgcgaggaccaguggugcggcagccugaucggccugaccgcccgcgccaccugggcgacgaacauccagguggccaucaaccagguccggcgccucaucgggaacgagaacuacuccgacuacaugaccagcaugaagcgguucaagaacgaguccgagcccgagggcgcccugugguga

SEQ ID NO: 8713 - RNA, 9879 nt, Artificial Sequence
  derived and/or modified CDS sequence (opt1) from DENV-1__GU131827__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguuccgcaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgccaucaacuggaagggccgcgagcucaagugcgggagcggcaucuucgucaccaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgcgggcauccucgcccaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggcguggaacaucugggagguggaggacuacggcuucgggaucuucacgaccaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagacgugcaucuggcccaagucccacacccuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccgugguggucgacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacgcuggccguguucuuccugcucaucauggggcagcugaccuggaacgaccugauccgccucugcaucauggugggcgcgaacgccagcgaccggauggggaugggcaccaccuaccuggcccugauggccacguucaagaugcgcccgauguucgccgucggccuccuguuccggcgccugaccucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcuccccgugcugcugggcagccucgggugcaagccgcugaccauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacgcugcucgccgucuccggcguguacccgcugagcauccccgccacccuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacgcgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcuccccgagaucgaggacgagguguuccgcaagcggaaccugaccaucauggaccugcaccccggcagcgggaagacccgccgguaccucccggccaucguccgcgaggccaucaagcgcaagcugcggacccugauccucgcccccacgcgcgugguggccuccgagauggcggaggcccugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgcgaacuuccgggccgaccgcgucaucgacccgcggcgcugccugaagcccgugauccugaaggacgggcccgagcgggugauccucgccggccccaugccggucaccguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucguccccgcccuguucgagccggagcgggagaaguccgccgcgaucgacggggaguaccgccugcggggcgaggcccgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacacgaucgagacccugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgucccccuccuggcccuggggugcuacagccaggugaacccccucacgcugaccgcggccgugcugaugcucgucgcccacuacgccaucaucggcccggggcugcaggccaaggcgacccgggaggcccagaagcgcaccgccgccggcaucaugaagaaccccacgguggacgggaucguggccaucgaccuggaccccgucguguacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggaggucgaccggagcgaggcgaaggagggccugaagcgcggggagaccaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugacgucccgcaugcugcucaaccgguucaccauggcccaccgcaagcccaccuacgagcgggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggcguaccacggguccuacgaggucaagccgagcggcuccgccagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgcgaaguggcuguggggcuuccucucccggaacaagaagccccgcaucugcacccgggaggaguucacgcgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcgcuccuggccaaguccaucuucaagcugaccuaccagaacaaggugguccgggugcagcgccccgccaagaacgggaccgugauggacgucaucagccggcgcgaccagcggggcuccggccaggugggcacguacggccucaacaccuucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8714 - RNA, 9879 nt, Artificial Sequence
  derived and/or modified CDS sequence (opt1) from DENV-1__GU131831__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaucagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugauccucagcaucgugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcguggagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8715 - RNA, 9879 nt, Artificial Sequence
  derived and/or modified CDS sequence (opt1) from DENV-1__EU482789__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagauggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcugaccgacuacggggcccucacccuggacugcagcccccgcacgggccuggacuucaacgagauggugcuccugaccaugaaggagaaguccuggcugguccacaagcagugguuccucgaccugccgcugcccuggaccagcggggccagcaccucccaggagacguggaaccggcaggaccuccuggugaccuucaagaccgcccacgcgaagaagcaggagguggucgugcugggcagccaggagggcgccaugcacaccgcccucacgggggccaccgagauccagaccuccggcaccacgaccaucuucgccgggcaccugaagugccgccugaagauggacaagcucacccugaagggcaugagcuacgugaugugcaccggguccuucaagcuggagaaggaggucgcggagacgcagcacggcaccgugcucgugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcugagcugguucaagaagggguccagcaucggcaagauguucgaggccaccgcccgcggggcccggcgcauggcgauccucggcgacacggccugggacuucggguccaucggcggcguguucaccagcguggggaagcugguccaccagaucuucggcaccgccuacggggugcuguucuccggcgugagcuggaccaugaagaucgggaucggcguccuccugacguggcugggccucaacucccgcagcaccucccugagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgugggcauccuggcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccuggggcuccugugcaucuccaucaugaucgaggaggugaugcgcagccgguggucccgcaagaugcugaugaccggcacccucgccguguuccugcugcucaucauggggcagcugacguggaacgaccugauccggcucugcaucauggucggcgccaacgcgagcgaccgcauggggaugggcaccaccuaccuggcccugauggccaccuucaagaugcgcccgauguucgccguggggcuccuguuccggcgccugacgucccgggaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgucggcguggugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacccggggcgccgugcugauguaccaggggaagcgccuggagcccagcugggcguccgugaagaaggaccucaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgcgaggggaagaucgucggccucuacggcaacgggguggugaccaccagcggcaccuacgucagcgcgaucgcccaggccaaggccucccaggaggggccgcugcccgagaucgaggacgagguguuccggaagcgcaaccugacgaucauggaccuccaccccggcagcgggaagacccggcgcuaccugccggcgaucgugcgggaggccaucaagcgcaagcugcggacccucauccuggcccccacccgcgucguggccuccgagauggccgaggcgcugaagggcaugcccauccgcuaccagacgaccgccgucaagagcgagcacaccggcaaggagaucgucgaccucaugugccacgccaccuucacgaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccugaagcccgucauccucaaggacgggcccgagcgcgugauccuggccggccccaugccggucacgguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccaccaugcuggacguggaccugcaccccgccuccgccuggacgcucuacgccgucgcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggugaacccccugacgcugaccgccgccguccucaugcugguggcgcacuacgccaucaucggcccggggcugcaggccaaggccacccgggaggcccagaagcgcaccgcggccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgucagcauggccaacaucuuccggggguccuaccuggccggcgccggccucgcguucagccugaugaagucccuggggcgcggccggcgcgggaccggcgcccagggggagacccucggcgagaaguggaagcggcagcugaaccagcuguccaagagcgaguucaacaucuacaagcgcuccggcaucauggagguggaccggagcgaggccaaggaggggcucaagcgcggcgagacgacccggcacgccgugucccgcgggaccgcgaagcugcggugguucgucgagcgcaaccuggugaagcccgagggcaaggugaucgaccuggggugcggccggggcggguggagcuacuacugcgccggccucaagaaggucaccgaggugaagggguacacgaagggcgggcccggccacgaggagcccaucccgauggccaccuacggcuggaaccuggugaagcugcacuccgggaaggacgucuucuucacgccgcccgagaagugcgacacccuccugugcgacaucggcgagagcucccccaacccgacgaucgaggaggggcgcacccugcgggugcucaagaugguggagcccuggcugcgcggcaaccaguucugcaucaagauccugaaccccuacaugcccagcgucguggagacccucgagcagaugcagcggaagcacgggggcaugcuggugcgcaacccgcugucccggaacagcacccacgagauguacugggucuccugcggcaccgggaacaucgugagcgccgugaacaugacgucccgcaugcuccugaaccgcuucaccauggcccaccggaagcccaccuacgagcgcgacgucgaccugggcgcggggacccggcacguggccguggagcccgaggucgccaaccucgacaucaucggccagcgcaucgagaacaucaagcacgagcacaagagcacguggcacuacgacgaggacaaccccuacaagaccugggccuaccacggcuccuacgaggugaagccgagcggguccgccagcagcauggucaacggcguggugaagcugcugaccaagcccugggacgucauccccauggugacccagaucgcgaugacggacaccacccccuucgggcagcagcggguguucaaggagaaggucgacacccgcacgccgaaggccaagcggggcaccgcccagaucauggaggugaccgcccgcuggcucuggggguuccugucccggaacaagaagccccgcaucugcacccgggaggaguucacgcgcaaggugcggagcaacgccgcgaucggcgccgucuucguggacgagaaccaguggaacuccgccaaggaggccguggaggacgagcgcuucugggaccugguccagaaggagcgggagcuccacaagcagggcaagugcgcgaccugcguguacaacaugauggggaagcgcgagaagaagcugggcgaguucgggaaggccaagggcagccgggccaucugguacauguggcugggggcccgcuuccucgaguucgaggcccugggcuucaugaacgaggaccacugguucucccgggagaacagccuguccggcguggagggggagggccuccacaagcugggguacauccugcgcgacaucagcaagauccccggcgggaacauguacgcggacgacaccgccggcugggacacccggaucacggaggacgaccuccagaacgaggccaagaucaccgacaucauggagccggagcacgcccugcuggccaccuccaucuucaagcucaccuaccagaacaaggucgugcgcgugcagcgccccgccaagagcggcacggucauggacgugaucucccggcgcgaccagcgggggagcggccagguggggaccuacggccugaacaccuucaccaacauggaggcgcagcugauccgccagauggaguccgagggcaucuuccuccccagcgagcuggagacgcccaaccuggccgagcggguccucgacuggcuggagaaguacgggguggagcgccugaagcggauggccaucuccggcgacgacugcguggucaagccgaucgacgaccgcuucgccaccgcgcucaccgcccugaacgacauggggaaggugcggaaggacaucccccagugggagcccagcaagggcuggaacgacuggcagcagguccccuucugcucccaccacuuccaccagcugaucaugaaggacgggcgcgagaucgucgugccgugccggaaccaggacgagcucgugggccgcgcccgggucagccagggcgccggguggagccugcgcgagaccgccugccugggcaaguccuacgcgcagauguggcagcucauguacuuccaccggcgcgaccugcggcuggccgccaacgccaucugcagcgcggugcccguggacuggguccccacgucccgcaccaccuggagcauccacgcccaccaccaguggaugaccacggaggacaugcucuccguguggaaccggguguggaucgaggagaaccccuggauggaggacaagacccacgucagcuccuggggcgacgugccguaccugggcaagcgcgaggaccaguggugcgggagccugaucggccucaccgcccgcgccaccugggccuccaacauccagguggcgaucaaccagguccggcgccugaucggcaacgagaacuaccuggacuacaugaccagcaugaagcgguucaagaacgagggggaccccgagggcgcccucugguga

SEQ ID NO: 8716 - RNA, 9879 nt, Artificial Sequence
  derived and/or modified CDS sequence (opt1) from DENV-1__EU482790__SS-prME
agcgugaccaugcugcugaugcugaugcccaccgcccuggccuuccaccucacgacccggggcggggagccccacaugaucgugagcaagcaggagcggggcaagagccugcuguucaagaccuccgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggguccagcaccucccaggagaccuggaaccggcaggaccuccuggugacguucaagaccgcccacgccaagaagcaggaggucguggugcugggcagccaggagggcgcgaugcacaccgcccucaccggggccacggagauccagaccuccggcaccaccacgaucuucgccgggcaccugaagugccgccugaagauggacaagcucacccugaagggcaugagcuacgucaugugcaccggguccuucaagcuggagaaggagguggccgagacccagcacggcacggugcucguccagaucaaguacgagggcaccgacgugcccugcaagauccccuucagcacccaggacgagaagggggugacccagaacggccggcugaucacggcgaacccgaucgucaccgacaaggagaagcccgugaacaucgaggccgagccgcccuucggggaguccuacaucgugaucggcgccggcgagaaggcccugaagcugagcugguucaagaagggguccagcaucggcaagauguucgaggcgaccgcccgcggggcccggcgcauggccauccucggcgacaccgccugggacuucggguccaucggcggcgucuucacgagcguggggaagcuggugcaccagaucuucggcaccgcguacgggguccuguucuccggcgugagcuggaccaugaagaucgggaucggcgugcuccugaccuggcugggccucaacucccgcagcacgucccugagcaugaccugcaucgccgucgggcuggugacccucuaccugggcgugaugguccaggccgacagcgggugcgugaucaacuggaagggccgggagcugaagugcggguccggcaucuucgugaccaacgagguccacacguggaccgagcaguacaaguuccaggccgacagcccgaagcgccucuccgccgcgaucggcaaggccugggaggagggggugugcggcauccggagcgccacccgccuggagaacaucauguggaagcagaucuccaacgagcugaaccacauccuccuggagaacgacaugaagcugaccguggucgugggggacguggccggcauccucgcccaggggaagaagaugauccggccccagcccauggaguacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacccaggugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacccuguggagcaacggcgugcucgaguccgagaugaucauccccaagaucuacgggggcccgaucagccagcacaacuaccgccccggguacuucacgcagaccgcgggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggucaagagcauggucuccgccggcagcggcgagguggacuccuucagccucgggcugcugugcaucuccaucaugaucgaggaggugaugcgcagccgguggucccgcaagaugcucaugaccggcacccuggccgucuucuuccugcucaucauggggcagcugaccuggaacgaccugauccggcucugcaucauggugggcgccaacgccagcgaccgcauggggaugggcacgaccuaccuggcgcugauggccaccuucaagaugcgcccgauguucgccgugggccuccuguuccggcgccugaccucccgggagguccuccugcugacgaucgggcucagccugguggccuccgucgagcugcccaacagccucgaggagcugggcgacgggcuggccaugggcaucaugauccucaagcugcugaccgacuuccagucccaccagcucugggcgacccugcugagccucaccuucaucaagacgaccuucucccugcacuacgccuggaagaccauggccauggugcugagcaucgugucccucuucccccugugccugagcaccacgucccagaagaccaccuggcuccccguccugcugggcagccucgggugcaagccgcugaccauguuccugaucgccgagaacaagaucuggggccgcaagagcuggccccucaacgaggggaucauggcggugggcaucguguccauccugcugagcucccuccugaagaacgacgucccccuggccgggccccucaucgccggcggcaugcugaucgccugcuacgugaucagcggguccagcgccgaccugucccucgagaaggcggccgaggugagcugggaggaggaggccgagcacuccggcgccagccacaacauccuggucgaggugcaggacgacgggacgaugaagaucaaggacgaggagcgggacgacacccugaccauccuccugaaggccacccugcucgcgguguccggcgucuacccgcugagcauccccgccacccuguucgugugguacuucuggcagaagaagaagcagcgcuccggggugcucugggacacgcccagcccgcccgaggucgagcgggccgugcuggacgacggcaucuaccgcaucaugcagcggggccugcuggggcgcucccaggugggcgucgggguguuccaggagaacguguuccacaccauguggcacgucacccggggcgccgugcucauguaccaggggaagcgccuggagcccagcugggccuccgugaagaaggaccugaucagcuacggcggcggguggcggcuccagggcuccuggaacaccggggaggagguccaggugaucgcgguggagcccggcaagaaccccaagaacguccagacggcccccgggaccuucaagaccagcgagggcgaggugggcgccaucgcccuggacuucaagcccgggaccagcggcucccccaucgugaaccgcgaggggaagaucgucggccuguacggcaacgggguggugacgaccagcggcaccuacgucuccgccaucgcgcaggccaaggccagccaggaggggccccucccggagaucgaggacgagguguuccggaagcgcaaccugaccaucauggaccugcaccccggcuccgggaagacgcggcgcuaccuccccgccaucgugcgggaggcgaucaagcgcaagcugcggacccugauccucgccccgacccgcgucguggccagcgagauggccgaggcccugaagggcaugcccauccgcuaccagaccacggcggugaaguccgagcacaccggcaaggagaucgucgaccugaugugccacgccaccuucaccaugcggcuccugagccccgugcgcgugcccaacuacaacaugaucaucauggacgaggcccacuucacggacccguccagcaucgccgcccggggguacaucuccacccgcgucggcaugggggaggcggccgccaucuucaugaccgccacgccgcccggcagcguggaggccuucccccaguccaacgcggugauccaggacgaggagcgggacaucccggagcgcagcuggaacuccggguacgaguggaucacggacuuccccggcaagaccgucugguucgugcccagcaucaaguccggcaacgacaucgccaacugccugcggaagaacgggaagcgcgugauccagcucagccggaagaccuucgacaccgaguaccagaagacgaagaacaacgacugggacuacgucgugaccaccgacaucuccgagaugggcgccaacuuccgcgccgaccgggugaucgacccccgccggugccugaagccggucauccugaaggacgggcccgagcgcgugauccucgcgggccccaugcccgucaccguggccagcgccgcccagcggcgcgggcggaucggccgcaaccacaacaaggagggcgaccaguacaucuacauggggcagccgcugaacaacgacgaggaccacgcccacuggacggaggcgaagaugcugcucgacaacaucaacacccccgagggcaucauccccgcccuguucgagcccgagcgggagaaguccgccgccaucgacggggaguaccgccugcgcggcgaggcccggaagaccuucguggagcucaugcgccgcggggaccugccggucuggcuguccuacaagguggcgagcgagggcuuccaguacuccgaccgccgguggugcuucgacggcgagcgcaacaaccaggugcucgaggagaacauggacgucgagaucuggaccaaggagggggagcggaagaagcugcgcccccgguggcuggacgcccgcacguacagcgacccccucgcccugcgggaguucaaggaguucgccgccggccgccgguccgugagcggggaccugauccucgagaucggcaagcugccccagcaccugacccagcgcgcgcagaacgcccucgacaaccuggugaugcugcacaacuccgagcagggcgggcgggccuaccgccacgccauggaggagcucccggacaccaucgagacccugaugcugcucgcgcugaucgccguccugacgggcggggugacccucuucuuccugagcggccgggggcugggcaagaccuccaucggccuccugugcgugauggccagcuccguccugcucuggauggccagcguggagccccacuggaucgccgcguccaucauccuggaguucuuccugauggugcuccugauccccgagcccgaccgccagcggaccccgcaggacaaccagcuggccuacgucgugaucgggcuccuguucaugauccugaccguggccgccaacgagaugggccuccuggagacgaccaagaaggaccuggggaucggccacgucgccguggagaaccaccaccacgcggccaugcucgacguggaccugcaccccgccagcgccuggacccuguacgccgucgcgaccacgaucaucacccccaugaugcgccacaccaucgagaacaccacggccaacaucucccucaccgccaucgccaaccaggccgcgauccugauggggcuggacaagggcuggccgaucagcaagauggacaucggcgugccccuccuggcccuggggugcuacucccaggugaacccccucacccugaccgccgccguccugaugcucguggcgcacuacgccaucaucggccccgggcugcaggccaaggccacgcgggaggcccagaagcgcaccgcggccggcaucaugaagaacccgaccguggacgggaucgucgccaucgaccuggaccccgugguguacgacgccaaguucgagaagcagcucggccagaucaugcugcugauccucugcaccagccagauccugcugaugcgcacgaccugggcccucugcgaguccaucacccuggcgaccggcccccugacgacccucugggaggggagccccggcaaguucuggaacaccaccaucgccgucagcauggccaacaucuuccggggguccuaccuggccggcgccggccuggcguucagccucaugaagucccucgggggcgggcgccgggggacgggggcccagggcgagacccugggcgagaaguggaagcgccagcucaaccagcugagcaaguccgaguucaacaccuacaagcggagcgggaucauggagguggaccgcuccgaggccaaggagggccugaagcgcggggagaccacgaagcacgccgugagccgcggcaccgcgaagcuccggugguucgucgagcgcaaccuggugaagccggaggggaaggugaucgaccugggcugcggccgcggcgggugguccuacuacugcgccgggcugaagaaggucaccgaggugaagggguacaccaagggcgggcccggccacgaggagcccauccccauggccacguacggguggaaccucgugaagcuguacagcggcaaggacgucuucuucaucccgcccgagaagugcgacacccugcucugcgacaucggggaguccagccccaaccccaccaucgaggagggccgcacccugcgggugcugaagaugguggagccguggcuccgcgggaaccaguucugcaucaagauccugaaccccuacaugcccuccgucguggagacgcuggagcagaugcagcggaagcacggcggcaugcucgugcgcaacccccugagccggaacuccacccacgagauguacugggucagcugcgggaccggcaacaucguguccgccgugaacaugaccagccgcaugcugcucaaccgguucaccauggcccaccgcaagccgacguacgagcgcgacgucgaccugggggcgggcacccggcacguggccguggagcccgagguccccaaccuggacaucaucggccagcgcaucgagaacaucaagcacgagcacaaguccaccuggcacuacgacgaggacaaccccuacaagaccugggccuaccacgggagcuacgaggugaagccgagcggcuccgccagcuccauggucaacgggguggugaagcuccugacgaagcccugggacgucauccccauggugacccagaucgccaugaccgacaccacgcccuucggccagcagcggguguucaaggagaaggucgacacccgcaccccgaaggcgaagcgggggaccgcccagaucauggaggugacggccaaguggcuguggggcuuccucagccgcaacaagaagccccggaucugcacccgcgaggaguucacccggaaggugcgcuccaacgccgccaucggcgcggucuucguggacgagaaccaguggaacagcgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggcgaaggggucccgggccaucugguacauguggcugggcgcccgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgccgacgacacggcgggcugggacacccggaucaccgaggacgaccugcagaacgaggccaagaucaccgacaucauggagccggagcacgcccuccuggccaagagcaucuucaagcugacguaccagaacaaggucgugcgcgugcagcggcccgccaagaacgggaccgucauggacgugaucucccgccgcgaccagcggggcagcggccaggugggcaccuacggccucaacaccuucacgaacauggaggcgcagcugauccgccagauggaguccgaggggaucuucagccccuccgagcuggagacccccaaccucgccggccggguccuggacuggcuggagaagcacgggguggagcgccucaagcggauggccaucagcggcgacgacugcguggucaagccgaucgacgaccgcuucgccaccgcccugaccgcgcugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggucccugcgcgagacggccugccucggcaagagcuacgcccagauguggcagcugauguacuuccaccggcgcgaccugcggcucgcggccaacgccaucugcuccgccgugcccguggacuggguccccaccagccgcaccaccugguccauccacgcgcaccaccaguggaugacgaccgaggacaugcugagcguguggaaccggguguggaucgaggagaaccccuggauggaggacaagacccacaucuccagcuggggcgacgucccguaccugggcaagcgcgaggaccaguggugcggcucccucaucgggcugaccgcccgggccacgugggccaccaacauccagguggccaucaaccaggugcgccgccugaucggcaacgagaacuaccucgacuacaugaccagcaugaagcgguucaagaacgaguccgaccccgagggggcgcugugguga

SEQ ID NO: 8717 - RNA, 9879 nt, Artificial Sequence
  derived and/or modified CDS sequence (opt1) from DENV-1__EU482791__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaugauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgggaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcacggggaacaucgugagcgccgugaacaugaccucccggaugcugcugaaccgcuucaccauggcccaccgcaagcccaccuacgagcgggacgucgaccucggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacggcaccgucauggacgugaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcguccuggacuggcuggagaaguacgggguggagcggcucaagcgcauggccaucagcggcgacgacugcguggucaagccgaucgacgaccgguucgccaccgcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgcggugcccguggacuggguccccaccagccggaccaccugguccauccacgcccaccaccaguggaugacgaccgaggacaugcugagcguguggaaccgcguguggaucgaggagaaccccuggauggaggacaagacccacgucuccagcuggggcgacgugccguaccugggcaagcgggaggaccaguggugcggcucccucaucgggcugaccgcccgcgccaccugggccagcaacauccagguggcgaucaaccagguccgccggcugaucggcaacgagaacuaccucgacuacaugacguccaugaagcgcuucaagaacgagggggaccccgagggcgcccugugguga

SEQ ID NO: 8718 - RNA, 9879 nt, Artificial Sequence
  derived and/or modified CDS sequence (opt1) from DENV-1__EU482792__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggggagcugugcgaggacaccaugaccuacaagugcccccggaucaccgagaccgagcccgacgacguggacugcuggugcaacgccaccgacaccugggugaccuacgggaccugcagccagaccggggagcaccggcgcgacaagcggagcguggcccucgcgccccacgugggccuggggcuggagacccgcaccgagacguggauguccagcgagggcgccuggaagcagauccagcggguggagaccugggcccuccgccaccccggguucaccgugaucgcccuguuccuggcccacgcgaucggcaccuccaucacgcagaaggggaucaucuucauccuccugaugcuggugacccccagcauggccaugcggugcgucggcaucggcucccgcgacuucguggaggggcucagcggcgccaccuggguggacgucgugcuggagcacggguccugcgugaccacgauggccaaggacaagcccacccuggacaucgagcuccugaagaccgaggucaccaaccccgccgugcugcggaagcucugcaucgaggcgaagaucagcaacacgaccaccgacucccgcugccccacccagggcgaggccacgcugauggaggagcaggacgccaacuucgugugccggcgcaccuucgucgaccggggcugggggaacggcugcgggcuguucggcaaggggagccucaucacgugcgccaaguucaagugcgugaccaagcuggagggcaagaucgugcaguacgagaaccugaaguacuccgucaucgugacggugcacaccggcgaccagcaccaggucgggaacgagagcaccgagcacggcaccaccgccacgaucacgccccaggcgcccaccuccgagauccagcucaccgacuacggggcccugacgcuggacugcagcccccgcaccggccucgacuucaacgagauggugcugcugaccaugaaggagaaguccuggcucguccacaagcagugguuccuggaccugccgcuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgugggcauccucgcccaggggaagaagaugauccggccccagcccauggagcacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguuccugcuccugaucauggggcagcugaccuggaacgaccucauccggcugugcaucauggucggcgccaacgccagcgaccgcauggggaugggcaccaccuaccuggcgcucauggccacguucaagaugcgcccgauguucgccgugggccugcuguuccggcgccucaccucccgggaggugcugcugcucaccaucgggcugagccuggucgccuccguggagcuccccaacagccuggaggagcugggcgacgggcucgccaugggcaucaugauccugaagcugcucaccgacuuccagucccaccagcugugggcgacgcugcucagccugaccuucaucaagaccacccugucccuccacuacgccuggaagacgauggccaugguccugagcaucgugucccuguucccccucugccugagcaccaccucccagaagaccacguggcugcccgugcuccugggcagccuggggugcaagccgcucaccauguuccugaucgccgagaacaagaucuggggccgcaaguccuggccccugaacgaggggaucauggcggucggcguggugagcauccuccugagcucccugcucaagaacgacgucccccuggccgggccccugaucgccggcggcaugcucaucgccugcuacgugaucagcggguccagcgccgaccugucccuggagaaggcggccgaggugagcugggaggaggaggccgagcacuccggcgccagccacaacauccucgucgaggugcaggacgacgggaccaugaagaucaaggacgaggagcgggacgacacccugaccauccugcucaaggccacgcugcuggcgguguccggcgucuacccgcucagcauccccgccacccuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacgcggggcgccgugcugauguaccaggggaagcgccucgagcccagcugggccuccgugaagaaggaccugaucagcuacggcggcggguggcggcugcagggcuccuggaacaccggggaggagguccaggugaucgcgguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucgugcgggaggcgaucaagcgcaagcuccggacccugauccuggcccccacgcgcgucguggccuccgagauggccgaggcccucaagggcaugcccauccgcuaccagaccaccgcggucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcccggggguacaucagcacccgcgucggcaugggggaggcggccgccaucuucaugacggccacgccgcccggcuccguggaggccuucccgcagagcaacgcggugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgccgaccgggugaucgacccgcgccggugccucaagcccgucauccugaaggacgggcccgagcgcgugauccuggcgggccccaugccggucaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucguggagcugaugcgccgcggggaccuccccgucuggcuguccuacaagguggcgagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgccggccgccggagcguguccggggaccugauccuggagaucggcaagcucccgcagcaccugacccagcgcgcgcagaacgcccuggacaaccucgugaugcugcacaacagcgagcagggcgggcgggccuaccgccacgccauggaggagcugcccgacacgaucgagacccucaugcugcuggcgcucaucgccguccugaccggcggggugacccuguucuuccucuccggccgggggcugggcaagaccagcaucggccugcucugcgugauggccuccagcguccugcuguggauggccuccguggagccccacuggaucgccgcgagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgccguggagaaccaccaccacgcgacgaugcuggacguggaccuccaccccgccuccgccuggacccuguacgccgucgccaccaccaucaucacgccgaugaugcgccacaccaucgagaacaccaccgcgaacaucagccugacggccaucgccaaccaggccgccauccucauggggcuggacaagggcuggcccaucuccaagauggacaucggcgugccccugcucgcgcuggggugcuacagccaggugaacccccugacccucaccgccgccguccugaugcugguggcccacuacgcgaucaucggcccggggcuccaggccaaggccacccgggaggcccagaagcgcacggccgcgggcaucaugaagaaccccaccguggacgggaucgucgccaucgaccuggaccccgugguguacgacgccaaguucgagaagcagcugggccagaucaugcuccugauccugugcaccucccagauccuccugaugcgcaccacgugggcccugugcgagagcaucacccucgccaccggcccccugaccacgcugugggagggguccccgggcaaguucuggaacaccaccaucgcggucagcauggccaacaucuuccggggguccuaccucgccggcgccggccuggccuucagccugaugaagucccucgggggcgggcgccggggcaccggggcgcagggcgagacgcugggcgagaaguggaagcgccagcugaaccagcucuccaagagcgaguucaacaucuacaagcgguccgggaucauggagguggaccgcagcgaggccaaggagggccugaagcgcggggagaccacccgccacgccgugucccggggcaccgccaagcugcgcugguucgucgagcggaaccuggugaagcccgaggggaaggugaucgaccucggcugcggccgcgggggcuggagcuacuacugcgcggggcugaagaaggucacggaggugaagggcuacaccaagggcgggcccggccacgaggagcccaucccgauggccaccuacggguggaaccuggugaagcuccacuccggcaaggacgucuucuucacgccgcccgagaagugcgacacgcugcugugcgacaucggggagagcucccccaacccgaccaucgaggagggccggacccuccgcgugcugaagaugguggagcccuggcugcgggggaaccaguucugcaucaagauccucaaccccuacaugcccagcgucguggagacccuggagcagaugcagcgcaaguacggcggcaugcuggugcggaacccgcucucccgcaacagcacccacgagauguacugggucuccugcgggacgggcaacaucgugagcgccgugaacaugaccucccggaugcugcugaaccgcuucaccauggcccaccgcaagcccaccuacgagcgggacgucgaccucggggccggcacgcgccacguggcgguggagcccgaggucgccaaccuggacaucaucggccagcggaucgagaacaucaagcacgagcacaagagcaccuggcacuacgacgaggacaaccccuacaagaccugggccuaccacggguccuacgaggugaagccgagcggcuccgccagcagcauggucaacgggguggugaagcugcucaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcuguggggcuuccugucccgcaacaagaagccccggaucugcacgcgcgaggaguucacccggaaggugcgcagcaacgccgccaucggcgcggucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgccgacgacaccgcgggcugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgccaagaacgggaccgucauggacgugaucagccgccgggaccagcgcggcuccggccaggugggcaccuacggccugaacaccuucacgaacauggaggcgcagcucauccggcagauggagagcgaggggaucuuccugcccuccgagcuggagacccccaaccucgccgagcgcguccuggacuggcuggagaaguacggcguggagcggcucaagcgcauggccaucagcggggacgacugcguggucaagccgaucgacgaccgguucgccaccgcccugaccgcgcugaacgacaugggcaaggugcgcaaggacaucccccagugggagcccuccaagggguggaacgacuggcagcagguccccuucugcagccaccacuuccaccagcucaucaugaaggacggccgggagaucgucgugccgugccgcaaccaggacgagcuggugggccgggcccgcgucucccagggggccggcuggagccugcgggagacggccugccucggcaagagcuacgcccagauguggcagcugauguacuuccaccgccgggaccugcgccucgcggccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacgucuccagcuggggcgacgugccguaccuggggaagcgggaggaccaguggugcggcucccucaucggccugaccgcccgcgccaccugggccagcaacauccagguggccaucaaccagguccgccggcugaucgggaacgagaacuaccucgacuacaugacguccaugaagcgcuucaagaacgagggcgaccccgagggggcgcugugguga

SEQ ID NO: 8719 - RNA, 9879 nt, Artificial Sequence
  derived and/or modified CDS sequence (opt1) from DENV-1__EU482707__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggugguggucgacgagcacugcgggaaccggggcccgucccuccgcaccaccaccgugacggggaagaucauccacgaguggugcugccggagcugcacccugccgccccugcgcuuccggggcgaggacgggugcugguacggcauggagauccgccccgugaaggagaaggaggagaaccucgucaaguccauggugagcgccggcagcggggagguggacuccuucagccugggccugcucugcaucuccaucaugaucgaggaggucaugcggagccgcuggucccggaagaugcugaugaccgggacccuggccguguucuuccuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucggccugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggaaguccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgcgacgacacccucaccauccugcugaaggccacccuccuggccgucuccgggguguacccgcugagcauccccgccacccucuucgugugguacuucuggcagaagaagaagcagcgguccggcguccugugggacacccccagcccgcccgagguggagcgcgccgugcuggacgacggcaucuaccggaucaugcagcgcgggcugcucggccggucccaggucggggugggcguguuccaggagaacgucuuccacaccauguggcacgugacccgcggggcggugcugauguaccagggcaagcggcuggagcccagcugggccuccgucaagaaggaccucaucagcuacggcgggggcuggcgccugcggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcggucgacggcgaguaccggcuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcgucuccggcgaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccgugcucaccgggggcgucacccuguucuuccuguccgggcggggccucggcaagaccagcaucgggcugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgcgaggcccagaagcggaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggcgaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgaggcgcucgagcagaugcagcggaagcacggcgggaugcuggugcgcaacccgcugucccggaacagcacccacgagauguacuggguguccugcggcaccgggaacaucgucagcgccgugaacaugaccucccgcaugcuccugaaccgcuucaccauggcccaccggaagcccacguacgagcgcgacguggaccugggcaccggcacccggcacgucgccguggagcccgagguggccaaccucgacaucaucgggcagcgcaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgcgcuggcucuggggcuuccugucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcuccacaagcagggcaagugcgccacgugcgucuacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagccggagcacgcgcugcuggccaaggccaucuucaagcucaccuaccagaacaaggugguccgcgugcagcggcccgccaagaacggcaccgugauggacgucaucucccgccgggaccagcgcgggagcggccaggugggcaccuacgggcugaacacguucaccaacauggaggcccagcugauccggcagauggaguccgagggcaucuucagccccuccgagcucgagacccccaaccuggcggagcgcgcccuggacuggcucgagaaguacgggguggagcggcugaagcgcauggccaucagcggcgacgacugcgucgugaagccgaucgacgaccgguucgccaccgcccugacggcgcucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagaccgccugccugggcaagagcuacgcgcagauguggcagcugauguacuuccaccgccgggaccuccgccuggccgccaacgccaucugcuccgccgugcccgucgacugggugcccaccagccggaccacgugguccauccacgcgcaccaccaguggaugaccaccgaggacaugcugagcguguggaaccgcgucuggaucgaggagaaccccuggauggaggacaagacccacaucuccagcugggaggacgugccguaccucgggaagcgcgaggaccaguggugcggcucccugaucggccugacggcccgggccaccugggccaccaacauccagguggccaucaaccagguccgccggcucaucgggaacgagaacuaccuggacuacaugaccagcaugaagcgcuucaagaacgaguccgaccccgagggcgcgcugugguga

SEQ ID NO: 8720 - RNA, 9879 nt, Artificial Sequence
  derived and/or modified CDS sequence (opt1) from DENV-1__EU482708__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgccguccucauguaccaggggaagcgccuggagcccagcugggcguccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgcccgagggcgaggucggcgccaucgcccuggacuucaagcccgggaccagcggcucccccaucgugaaccgcgaggggaagaucgugggccuguacggcaacggggucgugaccaccagcggcacguacgugagcgcgaucgcccaggccaaggccucccaggaggggccgcuccccgagaucgaggacgaggucuuccggaagcgcaaccugaccaucauggaccugcaccccggcagcgggaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccggcaaggagaucguggaccugaugugccacgccacguucaccaugcggcuccugucccccguccgcgugccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagacguucgacaccgaguaccagaagaccaagaacaacgacugggacuacguggucaccacggacaucagcgagaugggcgccaacuuccgcgcggaccgggugaucgacccgcgccggugccugaagcccgugauccugaaggacgggcccgagcgcgucauccucgccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugaucagcgagaucggcaagcucccgcagcaccugacccagcgcgcccagaacgcccuggacaaccucgugaugcugcacaacuccgagcagggcgggcgggccuaccgccacgcgauggaggagcugcccgacacgaucgagacccucaugcugcuggcccucaucgccgugcugaccggcggggucacccuguucuuccucagcggccgggggcugggcaagaccuccaucggccugcucugcgugauggccagcuccgugcugcuguggauggccagcgucgagccccacuggaucgcggccuccaucauccucgaguucuuccugauggugcugcucauccccgagccggaccgccagcggacgccccaggacaaccagcuggccuacguggucaucgggcuccucuucaugauccugaccguggccgccaacgagaugggccugcucgagaccaccaagaaggaccuggggaucggccacguggcggucgagaaccaccaccacgccgccaugcuggacguggaccuccaccccgccagcgccuggacgcuguacgcgguggccaccaccaucaucaccccgaugaugcgccacacgaucgagaacaccaccgccaacaucucccugaccgccaucgccaaccaggcggccauccucauggggcuggacaagggcuggcccaucagcaagauggacaucggcgucccccugcucgcccuggggugcuacucccaggugaacccccugacgcucaccgccgcggugcugaugcuggucgcccacuacgccaucaucggcccggggcuccaggccaaggccacccgcgaggcgcagaagcggaccgccgccggcaucaugaagaaccccacgguggacgggaucguggccaucgaccuggaccccgucguguacgacgccaaguucgagaagcagcugggccagaucaugcuccugauccugugcaccagccagauccuccugaugcgcaccaccugggcgcugugcgaguccaucacgcucgccaccggcccccugaccacccugugggaggggagcccgggcaaguucuggaacacgaccaucgccguguccauggccaacaucuuccgggggagcuaccucgccggcgcgggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggccaaggagggccugaagcgcggggagaccaccaagcacgcggugagccgcggcaccgccaagcugcggugguucguggagcgcaaccucgucaagcccgaggggaaggugaucgaccugggcugcggccgcggcgggugguccuacuacugcgccgggcugaagaaggugacggaggucaagggguacaccaagggcgggcccggccacgaggagcccaucccgauggccaccuacggguggaaccuggugaagcuccacagcggcaaggacguguucuucaucccgcccgagaagugcgacacccugcugugcgacaucggggaguccagccccaacccgacgaucgaggagggccgcacccuccggguccugaagaugguggagcccuggcugcgcgggaaccaguucugcaucaagauccucaaccccuacaugcccuccguggucgagacccuggagcagaugcagcggaagcacggcggcaugcuggugcgcaacccgcucagccggaacuccacccacgagauguacugggugagcugcgggaccggcaacaucgucuccgccgugaacaugacgagccgcaugcugcugaaccgcuucaccauggcgcaccggaagcccaccuacgagcgcgacguggaccucggggccggcacccggcacgucgccguggagcccgagguggccaaccuggacaucaucggccagcgcaucgagaacaucaagcacgagcacaaguccacguggcacuacgacgaggacaaccccuacaagaccugggccuaccacgggagcuacgaggucaagccguccggcagcgcgagcuccauggugaacggggucgugaagcugcucaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcuguggggcuuccugagccgcaacaagaagccccggaucugcacccgcgaggaguucacgcggaaggugcgcuccaacgcggccaucggcgccguguucgucgacgagaaccaguggaacagcgccaaggaggcgguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggccaucugguacauguggcucggcgcccgcuuccuggaguucgaggcgcugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucacggaggacgaccugcagaacgaggcccgcaucaccgacaucauggagccggagcacgcccugcucgcgcgcagcaucuucaagcugaccuaccagaacaaggugguccgggugcagcgccccgccaagaacgggaccgugauggacgucaucucccggcgcgaccagcggggcagcggccagguggggacguacggccugaacaccuucaccaacauggaggcccagcucauccgccagauggaguccgaggggaucuucagccccuccgagcuggagacccccaaccuggccgagcgggugcucgacuggcuggagaaguacggcgucgagcgccugaagcggauggccaucagcggggacgacugcguggugaagccgaucgacgaccgcuucgcgacggcccucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcccgggugagccagggggccggcuggucccugcgcgagaccgcgugccugggcaagagcuacgcccagauguggcagcucauguacuuccaccggcgcgaccugcggcuggccgccaacgcgaucugcuccgccguccccguggacuggauccccaccagccgcacgaccugguccauccacgcccaccaccaguggaugaccaccgaggacaugcucagcguguggaaccgcgucuggaucgaggagaaccccuggauggaggacaagacgcacaucuccagcuggggcgacgugccguaccuggggaagcgggaggaccaguggugcggcucccugaucggccucaccgcccgcgccaccugggcgaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8721 - RNA, 9879 nt, Artificial Sequence
  derived and/or modified CDS sequence (opt1) from DENV-1__EU482709__SS-prME
agcgugaccaugcugcugaugcuggugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgucggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggucacgcccuccauggccaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggcgaagaucuccaacaccacgaccgacagccgcugcccgacccagggcgaggccacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcgcccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcgucuucaccagcguggggaagcuggugcaccagaucuucggcaccgccuacgggguccucuucuccggcgugagcuggacgaugaagaucgggaucggcgugcugcugaccuggcucggccugaacucccgcagcaccucccugagcaugaccugcaucgccgucgggcucgugacgcuguaccugggcgugaugguccaggccgacuccgggugcgugaucaacuggaagggccgggagcucaagugcgggagcggcaucuucgugaccaacgagguccacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacgguggucgugggggacguggccggcauccucgcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgucgugguggacgagcacugcggcaaccgggggccgucccugcgcaccaccacggucaccggcaagaucauccacgaguggugcugccggagcugcacccugccgccccuccgcuuccgcggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacgcuggccgucuucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgugggccuccuguuccgccggcugaccucccgcgagguccuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgugucccucuucccccugugccugagcaccaccucccagaagaccacguggcuccccguccugcugggcagccucgggugcaagccgcugaccauguuccugaucgcggagaacaagaucuggggccggcgcuccuggccccucaacgaggggaucauggccgugggcaucgugagcauccugcugagcucccuccugaagaacgacgucccccuggccgggccccucaucgccggcggcaugcugaucgccugcuacgugaucagcggguccagcgcggaccugucccucgagaaggccgccgaggugagcugggaggaggaggccgagcacuccggcgccagccacaacauccuggucgaggugcaggacgacgggaccaugaagaucaaggacgaggagcgggacgacacccugaccauccuccugaaggcgacgcugcucgccguguccggcgucuacccgcugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgccgugcucauguaccaggggaagcgccuggagcccagcugggcguccgugaagaaggaccugaucagcuacggcggcggguggcggcuccagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccuguacggcaacgggguggugaccaccagcggcacguacgucagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucgugcgggaggccaucaagcgcaagcugcgcacccugauccucgcccccacgcgggucguggccuccgagauggccgaggcgcugaagggcaugcccauccgcuaccagaccaccgccgucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggccuccguggagccccacuggaucgcggccagcaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccaccaagaaggaccuggggaucggccacgucgcgguggagaaccaccaccacgccgccaugcucgacguggaccugcaccccgccuccgccuggacgcuguacgcggucgccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggugaacccccucacgcugaccgccgcgguccugaugcucguggcccacuacgccaucaucggcccggggcugcaggccaaggccacccgcgaggcgcagaagcggaccgccgccggcaucaugaagaaccccacgguggacgggaucgucgccaucgaccuggaccccgugguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgucagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggugucccgcggcaccgccaagcuccggugguucgucgagcgcaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugacgucccgcaugcugcucaaccgcuucaccauggcgcaccggaagcccaccuacgagcgcgacgucgaccugggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggugaagcuccugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccucucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaaggucgugcgcgugcagcggcccgccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcguccuggacuggcuggagaaguacggcguggagcggcucaagcgcauggccaucuccggggacgacugcguggucaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggccggcuggagccugcgggagaccgcgugccucgggaaguccuacgcccagauguggcagcugauguacuuccaccgccgggaccugcgccucgccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccuggggaagcgcgaggaccaguggugcggcagccucaucggccugaccgcccgggccaccugggcgaccaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8722 - RNA, 9879 nt, Artificial Sequence
  derived and/or modified CDS sequence (opt1) from DENV-1__EU482710__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaagcacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaaccaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccgugggccugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugaucagcgagaucggcaagcugccgcagcaccucacccagcgcgcgcagaacgcccuggacaaccuggucaugcuccacaacuccgagcagggcgggcgggccuaccgccacgccauggaggagcugcccgacacgaucgagacccugaugcuccuggcgcugaucgccgugcucaccggcggggugacccuguucuuccugagcggccgggggcucggcaagaccuccaucggccugcugugcgucauggccagcuccgugcuccuguggauggccagcguggagccccacuggaucgccgcguccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggccguggagaaccaccaccacgcgacgaugcuggacgucgaccugcaccccgccagcgccuggacccucuacgccguggccaccaccaucaucacgccgaugaugcgccacaccaucgagaacaccaccgcgaacaucucccugacggccaucgccaaccaggccgccauccugauggggcucgacaagggcuggcccaucagcaagauggacaucggcgugccccugcuggcgcucgggugcuacucccaggucaacccccugacccugaccgccgccgugcucaugcugguggcccacuacgcgaucaucggcccggggcugcaggccaaggccacccgggaggcccagaagcgcacggccgcgggcaucaugaagaaccccaccgucgacgggaucaucgccaucgaccucgaccccgugguguacgacgccaaguucgagaagcagcugggccagaucaugcugcucauccugugcaccagccagauccugcucaugcgcaccacgugggcccugugcgaguccaucacccuggccaccggcccccucaccacgcugugggaggggagcccgggcaaguucuggaacaccaccaucgcggucuccauggccaacaucuuccgggggagcuaccuggccggcgccggccucgccuucagccugaugaagucccucgggggcgggcgccgggggaccggggcgcagggcgagacgcucggcgagaaguggaagcgccagcugaaccagcugagcaaguccgaguucaacaucuacaagcggagcgggaucauggagguggaccgcuccgaggccaaggagggccucaagcgcggggagaccacccgccacgccgugagccggggcaccgccaagcugcgcugguucgucgagcggaaccuggugaagcccgaggggaaggugaucgaccugggcugcggccgcgggggcugguccuacuacugcgcggggcucaagaaggucacggaggugaagggcuacaccaagggcgggcccggccacgaggagcccaucccgauggccaccuacggguggaaccuggugaagcugcacagcggcaaggacgucuucuucacgccgcccgagaagugcgacacgcuccugugcgacaucggggaguccagccccaacccgaccaucgaggagggccggacccugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggacgggcaacaucguguccgccgugaacaugaccagccggaugcuccugaaccgcuucaccauggcccaccgcaagcccaccuacgagcgggacgucgaccugggggccggcacgcgccacguggcgguggagcccgaggucgccaaccucgacaucaucggccagcggaucgagaacaucaagcacgagcacaaguccaccuggcacuacgacgaggacaaccccuacaagaccugggccuaccacgggagcuacgaggugaagccguccggcagcgccagcuccauggucaacgggguggugaagcugcugaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcucuggggcuuccugagccgcaacaagaagccccggaucugcacgcgcgaggaguucacccggaaggugcgcuccaacgccgccaucggcgcggucuucguggacgagaaccaguggaacagcgccaaggaggccguggaggacgagcgguucugggaccugguccagaaggagcgcgagcuccacaagcaggggaagugcgcgaccugcguguacaacaugaugggcaagcgggagaagaagcugggggaguucggcaaggcgaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacaccgcgggcugggacacgcgcaucaccgaggacgaccuccagaacgaggccaagaucaccgacaucauggagccggagcacgcccugcuggccaccagcaucuucaagcucacguaccagaacaaggucgugcgggugcagcgccccgccaagaacgggaccgucauggacgugaucucccgccgggaccagcgcggcagcggccaggugggcaccuacggccugaacaccuucacgaacauggaggcgcagcugauccggcagauggaguccgaggggaucuuccuccccagcgagcuggagacccccaaccuggccgagcgcguccucgacuggcuggagaaguacggcguggagcggcugaagcgcauggccaucuccggggacgacugcguggucaagccgaucgacgaccgguucgccaccgcccucaccgcgcugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagacggccugccuggggaaguccuacgcccagauguggcagcucauguacuuccaccgccgggaccugcgccuggcggccaacgccaucugcagcgccgugcccguggacuggguccccaccucccggaccaccuggagcauccacgcgcaccaccaguggaugacgaccgaggacaugcucuccguguggaaccgcguguggaucgaggagaaccccuggauggaggacaagacccacgucagcuccuggggcgacgugccguaccuggggaagcgggaggaccaguggugcggcagccugaucggccucaccgcccgcgccaccugggccuccaacauccagguggccaucaaccagguccgccggcugaucgggaacgagaacuaccuggacuacaugacgagcaugaagcgcuucaagaacgagggcgaccccgagggggcgcucugguga

SEQ ID NO: 8723 - RNA, 9879 nt, Artificial Sequence
  derived and/or modified CDS sequence (opt1) from DENV-1__EU482712__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaacuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccgugcuguuccugcucaucauggggcagcugacguggaacgaccugauccggcucugcaucauggucggcgcgaacgccuccgaccgcauggggaugggcaccaccuaccuggcccugauggccaccuucaagaugcgcccgauguucgccgugggccuccuguuccggcgccugacgagccgggaggugcuccugcugaccaucgggcucucccuggucgcgagcguggagcugcccaacucccucgaggagcugggcgacgggcuggccaugggcaucaugauccucaagcugcugaccgacuuccagagccaccagcucugggccacccugcugucccucacguucaucaagaccaccuucagccugcacuacgccuggaagaccauggcgaugguccuguccaucgugagccucuucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgggacgacacccugaccauccuccugaaggccacccugcucgccgugagcggcguguacccgcuguccauccccgccacgcuguucgucugguacuucuggcagaagaagaagcagcgcagcggggugcucugggacacccccagcccgcccgagguggagcgggccguccuggacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacacgggggaggaggugcaggucaucgccguggagcccggcaagaaccccaagaacgugcagaccgcccccgggaccuucaagaccuccgagggcgaggucggcgccaucgcgcuggacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccucccggagaucgaggacgaggucuuccggaagcgcaaccugacgaucauggaccugcaccccggcagcgggaagacccggcgcuaccuccccgccaucgugcgggaggccaucaagcgcaagcugcggacccugauccucgccccgacccgcguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagaccuucgacacggaguaccagaagaccaagaacaacgacugggacuacguggucaccaccgacaucagcgagaugggcgcgaacuuccgcgccgaccgggugaucgacccccgccggugccugaagccggugauccugaaggacgggcccgagcgcgucauccucgccggccccaugcccgugacggucgccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggacgaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucacccccaugaugcgccacaccaucgagaacacgaccgccaacaucagccucaccgccaucgcgaaccaggccgccauccugauggggcuggacaagggcuggccgaucuccaagauggacaucggcgucccccuccuggcccuggggugcuacagccaggugaacccccucacccugacggcggccgugcugaugcucgucgcccacuacgccaucaucggccccgggcugcaggccaaggcgacccgggaggcccagaagcgcaccgccgccggcaucaugaagaacccgaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggaggggucccccggcaaguucuggaacaccacgaucgccgugagcauggccaacaucuuccgggggagcuaccuggcgggcgccggccuggccuucucccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccucgugaagcugcacuccggcaaggacguguucuucaucccgcccgagaagugcgacacccugcucugcgacaucggggagagcucccccaaccccaccaucgaggagggccgcacgcugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacccacgagauguacuggguguccugcgggaccggcaacaucgucagcgcggugaacaugaccucccgcaugcugcucaaccgguucacgauggcccaccgcaagccgaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcuccugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccucucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagcccgagcacgcgcuccuggccaaguccaucuucaagcugaccuaccagaacaaggugguccgcgugcagcggccggccaagaacgggaccgugauggacgucaucagccgccgcgaccagcggggcuccggccaggugggcaccuacggccucaacacguucaccaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccaccgcccugacggcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugcccuaccugggcaagcgcgaggaccaguggugcggcagccucaucgggcugacggcccgggcgaccugggccaccaacauccaggucgccaucaaccaggugcgccgccugaucggcaacgagaacuaccucgacuacaugaccuccaugaagcgguucaagaacgagagcgacccggagggggcccugugguga

SEQ ID NO: 8724 - RNA, 9879 nt, Artificial Sequence
  derived and/or modified CDS sequence (opt1) from DENV-1__EU249490__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccgcacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggcgcaccuucgacacggaguaccagaagaccaagaacaacgacugggacuacguggucaccaccgacaucagcgagaugggcgcgaacuuccgggccgaccgcgugaucgacccccggcgcugccucaagccggugauccugaaggacgggcccgagcgggucauccuggccggccccaugcccgugacggucgccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccgccugcggggcgaggcccgcaagaccuucguggagcugaugcggcgcggggaccucccgguguggcugagcuacaaggucgccuccgagggcuuccaguacagcgaccggcgcuggugcuucgacggcgagcggaacaaccaggugcuggaggagaacauggacguggagaucuggacgaaggagggggagcgcaagaagcuccggccccgcuggcuggacgcccggaccuacuccgacccccuggcccuccgcgaguucaaggaguucgcggccggccggcgcagcgucuccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacgcucaugcugcuggcccucaucgccgugcugaccggcggggucacccuguucuuccucuccggccgcgggcugggcaagaccagcaucggccugcucugcgugauggccuccagcgcgcugcuguggauggccuccguggagccccacuggaucgccgccagcaucauccucgaguucuuccugaugguccugcucauccccgagcccgaccggcagcgcaccccgcaggacaaccagcuggccuacguggugaucgggcuccucuucaugauccugacggucgcggccaacgagaugggccugcucgagaccaccaagaaggaccuggggaucggccacguggccguggagaaccaccaccacgccgccaugcuggacgucgaccuccaccccgcguccgccuggacccuguacgccguggccacgaccaucaucacccccaugaugcggcacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgcgaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcggaccaccugggcccugugcgagagcaucacccucgccacgggcccccugaccacccugugggaggggucccccggcaaguucuggaacaccacgaucgccgugagcauggcgaacaucuuccgcgggagcuaccucgccggcgccggccuggccuucucccugaugaagucccucgggggcgggcggcgcggcaccggggcgcagggcgagacccugggcgagaaguggaagcggcagcugaaccagcucuccaagagcgaguucaacaccuacaagcgcuccgggaucauggagguggaccggagcgaggccaaggagggccugaagcgcggggagacgaccaagcacgccgucucccggggcaccgccaagcugcgcugguucguggagcggaaccucgugaagccggaggggaaggucaucgaccugggcugcggccgcgggggcuggagcuacuacugcgccgggcugaagaaggugaccgaggugaagggcuacacgaagggcgggcccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccggacgcuccgcgugcugaagauggucgagccguggcugcgggggaaccaguucugcaucaagauccucaaccccuacaugcccagcgugguggagacccuggagcagaugcagcgcaagcacggcggcaugcugguccggaacccccucucccgcaacagcacccacgagauguacuggguguccugcgggaccggcaacaucgugagcgccgucaacaugaccucccggaugcugcugaaccgcuucacgauggcccaccgcaagccgaccuacgagcgggacguggaccucggggccggcacccgccacguggccgucgagcccgagguggcgaaccuggacaucaucggccagcggaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgcgucuucaaggagaagguggacacccggacccccaaggccaagcgcgggacggcgcagaucauggaggugaccgccaaguggcuguggggcuuccugucccggaacaagaagccgcgcaucugcacccgggaggaguucacccgcaagguccggagcaacgccgccaucggcgcgguguucguggacgagaaccaguggaacuccgccaaggaggccgucgaggacgagcgcuucugggaccucgugcaccgggagcgcgagcugcacaagcaggggaagugcgccacgugcguguacaacaugaugggcaagcgggagaagaagcugggggaguucggcaaggccaaggggagccgcgcgaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacaccgccggcugggacacccgcaucaccgaggacgaccugcagaacgaggcgaagaucacggacaucauggagcccgagcacgcccugcucgccaaguccaucuucaagcugaccuaccagaacaagguggugcggguccagcgcccggccaagaacgggaccgugauggacgugaucagccgccgggaccagcgcggcuccgggcaggucggcaccuacggccugaacacguucaccaacauggaggcccagcucauccggcagauggagagcgaggggaucuucucccccagcgagcuggagacccccaaccuggcgggccgcgugcucgacuggcuggagaagcacgggguggagcggcugaagcgcauggccaucuccggcgacgacugcgucgugaagcccaucgacgaccgguucgccaccgcccucacggcccugaacgacauggggaaggugcgcaaggacaucccgcagugggagcccagcaagggcuggaacgacuggcagcagguccccuucugcagccaccacuuccaccagcugaucaugaaggacggccgggagaucguggugcccugccgcaaccaggacgagcucgucgggcgggcgcgcgugucccagggcgccggguggagccugcgggagaccgccugccugggcaaguccuacgcccagauguggcagcucauguacuuccaccgccgggaccugcgccuggcggccaacgccaucugcagcgccgugccggucgacugggugcccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugcccuaccugggcaagcgggaggaccaguggugcggcagccugaucgggcucacggcgcgcgccaccugggccaccaacauccagguggccaucaaccagguccgccggcugaucggcaacgagaacuaccuggacuacaugaccuccaugaagcgcuucaagaacgagagcgacccggagggggcccucugguga

SEQ ID NO: 8725 - RNA, 9879 nt, Artificial Sequence
  derived and/or modified CDS sequence (opt1) from DENV-1__EU249491__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgccauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaagcucaccgucguggugggggacgucgccggcauccuggggcagggcaagaagaugauccggccccagcccauggaguacaaguacagcuggaaguccuggggcaaggccaagaucaucggggccgacgcgcagaacacgaccuucaucaucgacggccccaacaccccggagugccccgacgaccagcgcgccuggaacaucugggagguggaggacuacggguucggcaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggggugcuggaguccgagaugaucauccccaagaucuacggcgggccgaucagccagcacaacuaccgccccggcuacuucacccagaccgccgggcccuggcaccugggcaagcucgagcuggacuucgaccugugcgagggcaccacggucgugguggacgagcacugcgggaaccggggcccgucccuccgcaccaccaccgucacggggaagaucauccacgaguggugcugccggagcugcacccugccgccccugcgcuuccggggcgaggacgggugcugguacggcauggagauccgccccgugaaggagaaggaggagaaccucgugaaguccauggucagcgccggcagcggggagguggacuccuucagccugggccugcucugcaucuccaucaugaucgaggaggugaugcggagccgcuggucccggaagaugcugaugaccgggacccuggcggucuucuuccuccugaucaugggccagcugacguggaacgaccucauccgccugugcaucauggugggggccaacgccagcgaccgcaugggcaugggcaccaccuaccuggcccucauggccaccuucaagaugcggccgauguucgcgguggggcugcuguuccgccggcucacgucccgcgagguccugcugcucaccaucggccugagccugguggccuccguggagcuccccaacagccuggaggagcugggggacggccucgccaugggcaucaugauccugaagcugcucaccgacuuccagucccaccagcugugggccacccugcucagccugacguucaucaagaccaccuucucccugcacuacgcguggaagaccauggccaugguccucagcaucgugucccuguucccccugugccucagcacgaccucccagaagaccaccuggcugcccguccugcucgggagccugggcugcaagccgcugacgauguuccucaucgccgagaacaagaucugggggcggaaguccuggccccugaacgagggcaucauggccguggggaucgugagcauccugcucagcucccugcugaagaacgacgucccccucgccggcccccugaucgcgggcgggaugcugaucgccugcuacgugaucagcggcuccagcgccgaccucucccuggagaaggccgccgaggugagcugggaggaggaggcggagcacuccggggccagccacaacauccuggucgaggugcaggacgacggcaccaugaagaucaaggacgaggagcgcgacgacacccucaccauccugcugaaggccacccuccuggccguguccggggucuacccgcugagcauccccgccacccucuucgugugguacuucuggcagaagaagaagcagcgguccggcgugcugugggacacccccagcccgcccgaggucgagcgcgcggugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggccuccgugaagaaggaccucaucagcuacggcgggggcuggcgccugcggggguccuggaacacgggcgaggagguccaggugaucgccguggagcccgggaagaaccccaagaacguccagaccgcccccggcaccuucaagacccccgagggcgaggugggggcgaucgcccuggacuucaagcccggcacgagcgggucccccaucgugaaccgcgagggcaagaucgucggccucuacgggaacggcguggugaccaccagcgggaccuacgucagcgccaucgcccaggcgaaggccucccaggagggcccgcugcccgagaucgaggacgagguguuccggaagcgcaaccugacgaucauggaccuccaccccgggagcggcaagacccggcgcuaccugccggccaucgugcgggaggccaucaagcgcaagcugcgcacccucauccuggcccccacccgggucguggcguccgagauggccgaggcccugaagggcaugcccauccgcuaccagacgaccgccgucaagagcgagcacaccgggaaggagaucgucgaccucaugugccacgccaccuucacgaugcggcugcugucccccgugcgcgugccgaacuacaacaugaucaucauggacgaggcgcacuucaccgaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgcgaacugccuccggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccgcgccggugccugaagcccgucauccucaaggacggccccgagcgcgugauccuggccgggcccaugccggugacggucgccuccgcggcccagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgcggccguggacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacuccgacccccuggcgcugcgggaguucaaggaguucgccgccgggcgccggagcguguccggcgaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacgcugaugcuccuggcccugaucgccgugcucaccgggggcgugacccuguucuuccuguccgggcggggccucggcaagaccagcaucgggcugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucggccugcuguucaugauccucacggucgcggccaacgagauggggcugcuggagaccaccaagaaggaccucggcaucgggcacguggccguggagaaccaccaccacgccgccaugcuggacgucgaccugcaccccgcguccgccuggacccucuacgccguggccacgaccaucaucaccccgaugaugcgccacaccaucgagaacacgaccgccaacaucagccugaccgcgaucgccaaccaggccgccauccugaugggccucgacaagggcuggcccaucuccaagauggacaucggggugccccugcuggcgcucggcugcuacagccaggucaacccccugacccugacggccgccgugcucaugcugguggcccacuacgccaucaucgggccgggccugcaggcgaaggccacccgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggcgaacaucuuccggggcuccuaccuggccggcgccgggcucgccuucagccugaugaagucccugggcgggggccgccgggggaccggcgcgcagggcgagacccucggggagaaguggaagcgccagcugaaccagcuguccaagagcgaguucaacaccuacaagcgguccggcaucauggagguggaccgcagcgaggccaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggcgaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgcuucacgauggcccaccggaagcccaccuacgagcgcgacguggaccugggcaccggcacccggcacguggccgucgagcccgagguggccaaccucgacaucaucgggcagcgcaucgagaacaucaagcacgagcacaagagcacguggcacuacgacgaggacaaccccuacaagaccugggcguaccacggcuccuacgaggugaagccgagcggguccgccagcagcauggucaacggcguggucaagcugcugaccaagcccugggacgugauccccauggugacccagaucgccaugacggacaccacccccuucgggcagcagcgggucuucaaggagaagguggacacccgcacgccgaaggccaagcggggcaccgcccagaucauggaggugaccgcgcgcuggcucuggggcuuccugucccggaacaagaagccccgcaucugcacccgggaggaguucacgcgcaagguccggagcaacgccgccaucggggccguguucguggacgagaaccaguggaacuccgcgaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcgcugcuggccaaggccaucuucaagcucaccuaccagaacaagguggugcgcguccagcggcccgccaagaacggcaccgugauggacgugaucucccgccgggaccagcgcgggagcggccaggucggcacguacgggcugaacaccuucaccaacauggaggcccagcugauccggcagauggaguccgagggcaucuucagccccuccgagcucgagacccccaaccuggcggagcgcgcccuggacuggcucgagaaguacgggguggagcggcugaagcgcauggccaucagcggcgacgacugcguggucaagccgaucgacgaccgguucgccacggcccugaccgcgcucaacgacauggggaaggugcgcaaggacaucccccagugggagcccuccaagggcuggaacgacuggcagcagguccccuucugcagccaccacuuccaccagcugaucaugaaggacggccgggagaucgucgugccgugccgcaaccaggacgagcugguggggcgggcccgcgucucccagggcgccggguggagccuccgggagaccgccugccugggcaagagcuacgcgcagauguggcagcugauguacuuccaccgccgggaccuccgccuggccgccaacgccaucugcuccgccgugcccguggacuggguccccaccagccggacgaccugguccauccacgcgcaccaccaguggaugaccaccgaggacaugcugagcguguggaaccgcguguggaucgaggagaaccccuggauggaggacaagacgcacaucuccagcugggaggacgucccguaccucgggaagcgcgaggaccaguggugcggcucccugaucggccugaccgcccgggccaccugggccaccaacauccagguggccaucaaccaggugcgccggcucaucgggaacgagaacuaccuggacuacaugaccagcaugaagcgcuucaagaacgaguccgaccccgagggcgcgcugugguga

SEQ ID NO: 8726 - RNA, 9879 nt, Artificial Sequence
  derived and/or modified CDS sequence (opt1) from DENV-1__EU249492__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacgcagaugugcgaccaccgccucaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccggcucugcaucauggugggcgcgaacgccuccgaccgcauggggaugggcacgaccuaccuggcccugauggccaccuucaagaugcgcccgauguucgccgucgggcuccuguuccggcgccugaccagccgggaggugcuccugcugacgaucgggcucucccugguggcgagcgucgagcugcccaacucccucgaggagcugggcgacgggcuggccaugggcaucaugauccucaagcugcugaccgacuuccagagccaccagcucugggccacccugcuguccaugaccuucauccgcacgaccuucagccuccacuacgccuggaagaccauggcgauggugcuguccaucgucagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgugggcaucgucagcauccuccuguccagccugcucaagaacgacgugccccuggccgggccccugaucgccggcggcaugcucaucgcgugcuacgugaucuccgggagcuccgccgaccugagccuggagaaggccgccgaggucuccugggaggaggaggccgagcacagcggcgcgucccacaacauccucguggaggugcaggacgacgggacgaugaagaucaaggacgaggagcgcgacgacacccugaccauccugcucaaggccacccugcuggccgucagcggcguguacccgcucuccauccccgccacccuguucgugugguacuucuggcagaagaagaagcagcggagcgggguccugugggacacgcccagcccgcccgaggugcagcgcgccgugcucgacgacggcaucuaccggaucaugcagcgcggccugcuggggcggagccaggucggcguggggguguuccaggagaacgucuuccacaccauguggcacgugacccgcggcgcggugcugauguaccaggggaagcggcucgagcccuccugggccagcgucaagaaggaccugaucuccuacggcggcggguggcgccugcagggcagcuggaacaccggggaggagguccaggugaucgccgucgagcccggcaagaaccccaagaacgugcagacggcccccgggaccuucaagaccuccgagggcgaggugggcgccaucgcgcucgacuucaagcccgggaccagcggcagccccaucgucaaccgggaggggaagaucgugggccuguacggcaacgggguggucacgaccuccggcaccuacgugagcgccaucgcccaggccaaggcgucccaggaggggccccugccggagaucgaggacgagguguuccgcaagcggaaccucaccaucauggaccugcaccccggcagcgggaagacgcgccgguaccugcccgccaucguccgcgaggccaucaagcggaagcuccgcacccugauccuggccccgacccgcgugguggccuccgagauggcggaggcccucaagggcaugcccauccgguaccagaccacggccgucaagagcgagcacaccggcaaggagaucguggaccugaugugccacgccaccuucaccaugcgccugcucucccccgugcggguccccaacuacaacaugaucaucauggacgaggcccacuucacggacccgagcuccaucgcggcccgcggguacaucagcacccgggugggcaugggggaggccgccgccaucuucaugaccgcgacgccgcccggcuccguggaggccuucccccagagcaacgccgucauccaggacgaggagcgcgacaucccggagcgguccuggaacagcggguacgaguggaucacggacuuccccggcaagaccgugugguucgugcccuccaucaagagcggcaacgacaucgccaacugccugcgcaagaacgggaagcgggucauccagcugucccgcaagaccuucgacaccgaguaccagaagacgaagaacaacgacugggacuacguggugaccaccgacaucagcgagaugggcgcgaacuuccgggccgaccgcgucaucgacccccggcgcugccucaagccggugauccugaaggacgggcccgagcgggugauccuggccggccccaugcccgucaccguggccuccgccgcgcagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccgccugcggggcgaggcccgcaagaccuucgucgagcugaugcggcgcggggaccucccgguguggcugagcuacaagguggccuccgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggacguacuccgacccccuggcccuccgcgaguucaaggaguucgcggccggccggcgcagcguguccggggaccugauccuggagaucggcaagcucccccagcaccugacccagcgggcccagaacgcccuggacaaccucgucaugcugcacaacagcgagcagggcgggcgcgcguaccggcacgccauggaggagcugccggacaccaucgagacccucaugcugcuggcccucaucgccgugcugacgggcggggugacccuguucuuccucuccggccgcgggcugggcaagaccagcaucggccugcucugcgucauggccuccagcgugcugcuguggauggcguccguggagccccacuggaucgccgccagcaucauccucgaguucuuccugaugguccugcucauccccgagcccgaccggcagcgcaccccgcaggacaaccagcuggccuacguggugaucgggcuccuguucaugauccugaccgucgccgcgaacgagaugggccugcucgagacgaccaagaaggaccuggggaucggccacguggccguggagaaccaccaccacgccgccaugcuggacgucgaccuccaccccgccuccgcguggacccuguacgccguggccaccacgaucaucacccccaugaugcggcacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggucaacccccugacccucaccgcggccgugcugaugcugguggcccacuacgccaucaucggccccgggcuccaggccaaggcgacgcgcgaggcccagaagcgcaccgccgccggcaucaugaagaacccgaccgucgacgggaucguggccaucgaccuggaccccguggucuacgacgcgaaguucgagaagcagcugggccagaucaugcuccugauccugugcaccucccagauccuccugaugcggacgaccugggcccugugcgagagcaucacccucgccaccggcccccugacgacccugugggaggggucccccggcaaguucuggaacaccaccaucgccgugagcauggccaacaucuuccgcgggagcuaccucgcgggcgccggccuggccuucucccugaugaagucccucgggggcucccggcgcgggacgggcgcccagggggagacccugggcgagaaguggaagcggcagcugaaccagcucagcaaguccgaguucaacaccuacaagcgcagcggcaucauggagguggaccgguccgaggcgaaggaggggcugaagcgcggcgagaccacgaagcacgccgucagccgggggaccgccaagcugcgcugguucguggagcggaaccucgugaagccggagggcaaggucaucgaccuggggugcggccgcggcgggugguccuacuacugcgccggccugaagaaggugaccgaggugaagggguacaccaagggcgggcccggccacgaggagcccauccccauggccacguacggcuggaaccuggucaagcuccacagcgggaaggacguguucuucaucccgcccgagaagugcgacacccugcugugcgacaucggcgaguccagccccaaccccaccaucgaggaggggcggacccuccgcgugcugaagauggucgagccguggcugcggggcaaccaguucugcaucaagauccucaaccccuacaugcccuccgugguggagacgcuggagcagaugcagcgcaagcacgggggcaugcugguccggaacccccucagccgcaacuccacccacgagauguacugggugagcugcggcaccgggaacaucguguccgcggucaacaugaccagccggaugcugcugaaccgcuucaccauggcccaccgcaagccgacguacgagcgggacguggaccucggcgccgggacccgccacguggccgucgagcccgagguggccaaccuggacaucaucggccagcggaucgagaacaucaagcacgagcacaaguccaccuggcacuacgacgaggacaaccccuacaagaccugggcguaccacggcagcuacgaggugaagcccagcggguccgccagcuccauggucaacggcguggucaagcugcucacgaagccgugggacgugauccccauggugacccagaucgccaugaccgacaccacgcccuucgggcagcagcgcgucuucaaggagaagguggacacccggacccccaaggccaagcgcggcaccgcccagaucauggaggugacggcgaaguggcuguggggguuccugagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggggcgcgguuccuggaguucgaggcccugggcuucaugaacgaggaccacugguucagccgcgagaacucccucagcggcgucgagggggagggccugcacaagcugggguacauccuccgggacaucuccaagauccccggcgggaacauguacgccgacgacacggccggcugggacacccgcaucaccgaggacgaccugcagaacgaggccaagaucaccgacaucauggagcccgagcacgcgcugcucgccaagagcaucuucaagcugacguaccagaacaagguggugcggguccagcgcccggccaagaacggcaccgugauggacgugaucucccgccgggaccagcgcgggagcggccaggucgggaccuacggccugaacaccuucacgaacauggaggcccagcucauccggcagauggaguccgagggcaucuucagccccuccgagcuggacacccccaaccuggccgggcgcgugcucgacuggcuggagaagcacggcguggagcggcugaagcgcauggcgaucagcggggacgacugcgucgugaagcccaucgacgaccgguucgccaccgcccucaccgcccugaacgacaugggcaaggugcgcaaggacaucccgcagugggagcccagcaagggguggaacgacuggcagcagguccccuucugcucccaccacuuccaccagcugaucaugaaggacggccgggagaucguggugcccugccgcaaccaggacgagcucgucggccgggcccgcgugagccagggggcgggcuggucccugcgggagacggccugccugggcaagagcuacgcccagauguggcagcucauguacuuccaccgccgggaccugcgccuggccgcgaacgccaucugcuccgccgugccggucgacugggugcccaccagccggaccaccugguccauccacgcccaccaccaguggaugacgaccgaggacaugcucagcguguggaaccgcgucuggaucgaggagaaccccuggauggaggacaagacccacaucuccagcuggggcgacgugcccuaccuggggaagcgggaggaccaguggugcggcucccugaucggccucaccgcccgcgcgacgugggccaccaacauccagguggccaucaaccagguccgccggcugcuggggaacgagaacuaccucgacuacaugaccagcaugaagcgcuucaagaacgaguccggcccggagggggcccugugguga

SEQ ID NO: 8727 - RNA, 9879 nt, Artificial Sequence
  derived and/or modified CDS sequence (opt1) from DENV-1__EU249493__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgacaccgccugccugggcaaguccuacgcccagauguggcagcucauguacuuccaccggcgcgaccugcggcuggccgcgaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8728 - RNA, 9879 nt, Artificial Sequence
  derived and/or modified CDS sequence (opt1) from DENV-1__EU249494__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgccaugguccaggcggacuccgggugcgugaucaacuggaagggccgggagcucaagugcgggagcggcaucuucgugacgaacgagguccacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugacguggaacgaccucauccggcugugcaucauggugggcgcgaacgccagcgaccgcauggggaugggcaccaccuaccuggcccucauggccaccuucaagaugcgcccgauguucgccgucgggcugcuguuccggcgccucacgucccgggaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccacccugucccuccacuacgccuggaagaccauggcgauggugcugagcaucgucucccuguucccccucugccugagcacgaccucccagaagaccaccuggcugcccgugcuccugggcagccuggggugcaagccgcucacgauguuccugaucgccgagaacaagaucuggggccgcaaguccuggccccugaacgaggggaucauggccgugggcgucgugagcauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugaccauccugcucaaggccacccugcuggccguguccggcguguacccgcucagcauccccgccacgcuguucgucugguacuucuggcagaagaagaagcagcgcuccggggugcugugggacacccccagcccgcccgagguggagcgggccguccuggacgacggcaucuaccgcaucaugcagcggggccuccuggggcgcucccaggugggcgugggggucuuccaggagaacguguuccacaccauguggcacgugacccggggcgcgguccugauguaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcgcucgacuucaagcccgggacgagcggcucccccaucgugaaccgcgaggggaagaucgugggccuguacggcaacggggucgugaccaccagcggcaccuacgugagcgccaucgcccaggccaaggcgucccaggaggggccgcugcccgagaucgaggacgaggucuuccggaagcgcaaccucacgaucauggaccugcaccccggcagcgggaagacccggcgcuaccugccggccaucgugcgggaggccaucaagcgcaagcuccggacccugauccuggcccccacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccgcgccggugccucaagcccgugauccugaaggacgggcccgagcgcgucauccuggccggccccaugccggugacggucgccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgggagaaguccgccgcgaucgacggggaguaccgccugcgcggcgaggcccggaagaccuucguggagcugaugcgccgcggggaccuccccguguggcuguccuacaaggucgccagcgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagccggaccgccagcggacgccccaggacaaccagcuggccuacguggucaucgggcuccucuucaugauccugacgguggccgcgaacgagaugggccugcucgagaccaccaagaaggaccuggggaucggccacguggccgucgagaaccaccaccacgccaccaugcuggacguggaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgucccccugcucgcccuggggugcuacagccaggugaacccccugacgcucaccgccgcggugcugaugcuggucgcccacuacgccaucaucggcccggggcuccaggccaaggccacccgggaggcgcagaagcgcaccgccgccggcaucaugaagaaccccacgguggacgggaucguggccaucgaccuggaccccgucguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacaucuacaagcgguccgggaucauggaggucgaccgcagcgaggccaaggagggccugaagcgcggggagacgacccgccacgcggugucccggggcaccgccaagcugcgcugguucguggagcggaaccuggucaagcccgaggggaaggugaucgaccucggcugcggccgcgggggcuggagcuacuacugcgccgggcugaagaaggugaccgaggucaagggcuacacgaagggcgggcccggccacgaggagcccaucccgauggccaccuacggguggaaccuggugaagcuccacuccggcaaggacguguucuucacgccgcccgagaagugcgacacccugcugugcgacaucggggagagcucccccaacccgacgaucgaggagggccggacccuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugacgucccggaugcugcugaaccgcuucaccauggcgcaccgcaagcccaccuacgagcgggacguggaccucggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcucaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgcccgguggcuguggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccucgugcagaaggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagauccccgggggcaacauguacgccgacgacaccgccggcugggacacccgcaucacggaggacgaccugcagaacgaggccaagaucaccgacaucauggagccggagcacgcccugcucgcgaccuccaucuucaagcugaccuaccagaacaaggugguccgggugcagcgccccgccaagaacgggacggugauggacgucaucagccgccgggaccagcgcggcuccggccaggugggcaccuacggccugaacaccuucaccaacauggaggcccagcucauccggcagauggagagcgaggggaucuucucccccagcgagcuggagauccccaaccuggccgagcgcgugcucgacuggcuggagaaguacggcgucgagcggcugaagcgcauggccaucuccggggacgacugcguggugaagccgaucgacgaccgguucgcgacggcccucaccgcccugaacgacaugggcaagguccgcaaggacgugccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagaccgcgugccuggggaaguccuacgcccagauguggcagcucauguacuuccaccgccgggaccugcgccuggccgccaacgcgaucugcagcgccgugcccguggacuggguccccaccucccggacgaccuggagcauccacgcccaccaccaguggaugaccaccgaggacaugcucuccguguggaaccgcguguggaucgaggagaaccccuggauggaggacaagacgcacgucagcuccuggggcgacgugccguaccuggggaagcgggaggaccaguggugcggcagccugaucggccucaccgcccgcgccaccugggcguccaacauccagguggccaucaaccagguccgccggcugaucgggaacgagaacuaccuggacugcaugaccagcaugaagcgcuucaagaacgagggcgaccccgagggggcccucugguga

SEQ ID NO: 8729 - RNA, 9879 nt, Artificial Sequence
  derived and/or modified CDS sequence (opt1) from DENV-1__EU249495__SS-prME
agcgugaccaugcugcucaugcugaugcccaccgcccuggccuuccaccucaccacccggggcggggagccccacaugaucgugaccaagcaggagcggggcaagagccugcuguucaagaccaccgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacccgcaccgagacguggaugagcuccgagggcgccuggaagcagauccagcggguggagaccugggcccuccgccaccccggguucaccgugaucgcccuguuccuggcgcacgccaucggcaccagcaucacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgcggugcugcggaagcucugcaucgaggccaagaucuccaacacgaccaccgacagccgcugccccacccagggcgaggccacgcugauggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugacggugcacaccggcgaccagcaccaggucgggaacgaguccaccgagcacggcaccaccgcgacgaucacgccccaggcccccaccagcgagauccagcucaccgacuacggggcccugacgcuggacugcagcccccggaccggccucgacuucaacgagauggugcugcugaccaugaaggagaaguccuggcucguccacaagcagugguuccuggaccugccgcuccccuggaccuccggggccagcacgagccaggagaccuggaaccggcaggaccugcuggugaccuucaagaccgcccacgcgaagaagcaggagguggucgugcucggcucccaggagggcgccaugcacacggcccugaccggggccaccgagauccagaccagcggcacgaccaccaucuucgccgggcaccugaagugccgccucaagauggacaagcugacccugaagggcauguccuacgugaugugcacggggagcuucaagcucgagaaggaggucgcggagacccagcacggcaccgugcuggugcagaucaaguacgagggcaccgacgcccccugcaagauccccuucuccacgcaggacgagaagggggucauccagaacggccggcugaucaccgccaacccgaucgugaccgacaaggagaagcccgugaacaucgaggccgagccgcccuucggggagagcuacaucgucaucggcgugggcgagaaggcgcugaagcucuccugguucaagaaggggagcuccaucggcaagauguucgaggccaccgcccgcggggcccggcgcauggccauccugggcgacacggcgugggacuucgggagcaucggcggcguguucaccuccgucgggaagcuggugcaccagaucuucggcaccgccuacgggguccuguucagcggcgucuccuggaccaugaagaucgggaucggcgugcugcugacguggcucggccugaacagccgcuccaccagccuguccaugaccugcaucgccguggggcucgucacccuguaccugggcgugauggugcaggccgacagcgggugcgucaucaacuggaagggccgggagcucaagugcggguccggcaucuucgugacgaacgaggugcacaccuggaccgagcaguacaaguuccaggccgacagcccgaagcgccugagcgcggccaucggcaaggccugggaggagggggucugcggcauccgguccgccacccgccuggagaacaucauguggaagcagaucagcaacgagcucaaccacauccugcuggagaacgacaugaaguucaccgugguggucggggacguggugggcauccucgcccaggggaagaagaugauccggccccagcccauggagcacaaguacuccuggaaguccuggggcaaggcgaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacuccuacacccaggccugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacgcugugguccaacggcgugcucgagagcgagauggugauccccaagaucuacgggggcccgaucucccagcacaacuaccgccccggguacuucacccagaccgccggccccuggcaccuggggaagcuggagcucgacuucgaccugugcgagggcaccacggucgugguggacgagcacugcggcaaccgggggccgagccugcgcaccaccaccgucacgggcaagaucauccacgaguggugcugccgguccugcacccugccgccccuccgcuucaagggggaggacggcugcugguacgggauggagauccggcccgugaaggagaaggaggagaaccuggucaagagcauggucuccgccggcagcggcgagguggacagcuucucccucgggcugcugugcaucagcaucaugaucgaggaggugaugcgcucccgguggagccgcaagaugcucaugaccggcacccuggccgucuuccugcuccugaucauggggcagcugacguggaacgaccucauccggcugugcaucauggugggcgccaacgcguccgaccgcauggggaugggcaccaccuaccuggcccucauggccaccuucaagaugcgcccgauguucgccguggggcugcuguuccggcgccucacgagccgggagguccugcugcucaccaucgggcugucccugguggccagcgucgagcuccccaacucccuggaggagcugggcgacgggcucgcgaugggcaucaugauccugaagcugcucaccgacuuccagagccaccagcugugggccacccugcucucccugacguucaucaagaccacccugagccuccacuacgccuggaagaccauggccauggugcuguccaucgugagccuguucccccucugccuguccacgaccagccagaagaccaccuggcugcccguccuccugggcucccuggggugcaagccgcucacgauguuccugaucgcggagaacaagaucuggggccgcaagagcuggccccugaacgaggggaucauggccgugggcguggucuccauccuccugagcagccugcucaagaacgacgugccccuggccgggccccugaucgccggcggcaugcucaucgccugcuacgugaucuccgggagcuccgcggaccugagccuggagaaggccgccgaggucuccugggaggaggaggccgagcacagcggcgccucccacaacauccucguggaggugcaggacgacgggaccaugaagaucaaggacgaggagcgggacgacacccugaccauccugcucaaggcgacccugcuggccgucagcggcguguacccgcucuccauccccgccacgcuguucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacaccauguggcacgugacccggggcgccgugcugauguaccaggggaagcgccucgagcccuccugggcgagcgucaagaaggaccugaucuccuacggcggcggguggcggcugcagggcagcuggaacacgggggaggagguccaggugaucgccgucgagcccggcaagaaccccaagaacgugcagaccgcccccgggaccuucaagacccccgagggcgaggugggcgccaucgcccucgacuucaagcccgggacguccggcagccccaucgucaaccgcgaggggaagaucgugggccuguacggcaacgggguggucaccaccuccggcaccuacgugagcgcgaucgcccaggccaaggccagccaggaggggccgcugcccgagaucgaggacgagguguuccggaagcgcaaccucacgaucauggaccugcaccccggcuccgggaagacccggcgcuaccugccggcgaucguccgggaggccaucaagcgcaagcuccggacccugauccuggcccccacccgcgugguggccagcgagauggccgaggcgcucaagggcaugcccauccgcuaccagacgaccgccgucaaguccgagcacaccggcaaggagaucguggaccugaugugccacgccaccuucacgaugcggcugcucagccccgugcgcgucccgaacuacaacaugaucaucauggacgaggcccacuucaccgaccccuccagcaucgccgcgcggggguacaucuccacccgcgugggcaugggggaggccgccgccaucuucaugaccgccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccugcggaagaacgggaagcgcgucauccagcugagccggaagaccuucgacacggaguaccagaagaccaagaacaacgacugggacuacguggugaccaccgacaucuccgagaugggcgccaacuuccgcgcggaccgggucaucgacccgcgccggugccucaagcccgugauccugaaggacgggcccgagcgcgucauccuggccggccccaugccggugacgguggccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcugagcuacaagguggccuccgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacagcgacccccuggcccuccgggaguucaaggaguucgccgcgggccgccgguccgugagcggggaccugauccuggagaucggcaagcucccgcagcaccugacccagcgcgcccagaacgcccuggacaaccucgucaugcugcacaacuccgagcagggcgggcgggccuaccgccacgcgauggaggagcugcccgacaccaucgagacgcucaugcugcuggcccucaucgccgugcugaccggcggggugacccuguucuuccucagcggccgggggcugggcaagaccuccaucggccugcucugcgucauggccagcuccgugcugcuguggauggccagcguggagccccacuggaucgcggccuccaucauccucgaguucuuccugaugguccugcucauccccgagccggaccgccagcggacgccccaggacaaccagcuggccuacguggugaucgggcuccucuucaugauccugacggucgccgccaacgagaugggccugcucgagaccaccaagaaggaccuggggaucggccacguggcgguggagaaccaccaccacgccaccaugcuggacgucgaccuccaccccgccagcgccuggacgcuguacgccguggcgaccaccaucaucaccccgaugaugcgccacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggucaacccccugacgcucaccgccgccgugcugaugcugguggcgcacuacgccaucaucggcccggggcuccaggccaaggccacccgggaggcccagaagcgcaccgcggccggcaucaugaagaaccccacggucgacgggaucguggccaucgaccuggaccccguggucuacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccguguccauggccaacaucuuccgggggagcuaccucgccggcgccggccuggcguucucccugaugaagucccucgggggcgggcgccggggcaccggggcccagggcgagacccugggcgagaaguggaagcgccagcugaaccagcucagcaaguccgaguucaacaucuacaagcggagcgggaucauggagguggaccgcuccgaggccaaggagggccugaagcgcggggagacgacccgccacgccgucagccggggcaccgcgaagcugcgcugguucguggagcggaaccuggugaagcccgaggggaaggucaucgaccucggcugcggccgcgggggcugguccuacuacugcgccgggcugaagaaggugaccgaggugaagggcuacacgaagggcgggcccggccacgaggagcccaucccgauggccaccuacggguggaaccuggucaagcuccacagcggcaaggacguguucuucacgccgcccgagaagugcgacacccugcugugcgacaucggggaguccagccccaacccgacgaucgaggagggccggacccuccgcgugcugaagauggucgagcccuggcugcgggggaaccaguucugcaucaagauccucaaccccuacaugcccuccgugguggagacccuggagcagaugcagcgcaagcacggcggcaugcugguccggaacccgcucagccgcaacuccacccacgagauguacugggugagcugcgggaccggcaacaucguguccgccgucaacaugacgagccggaugcugcugaaccgcuucaccauggcccaccgcaagcccaccuacgagcgggacguggaccucggggcgggcacccgccacguggccgucgagcccgagguggccaaccuggacaucaucggccagcggaucgagaacaucaagcacgagcacaaguccacguggcacuacgacgaggacaaccccuacaagaccugggccuaccacgggagcuacgaggucaagccguccggcagcgccuccagcauggugaacgggguggucaagcugcucaccaagcccugggacgugauccccauggugacccagaucgcgaugacggacaccacccccuucggccagcagcgcgucuucaaggagaagguggacacccggacgccgaaggccaagcgcgggaccgcccagaucauggaggugaccgcccgguggcuguggggcuuccugagccgcaacaagaagccccggaucugcacccgcgaggaguucacgcggaagguccgcuccaacgccgcgaucggcgccguguucguggacgagaaccaguggaacagcgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagauccccgggggcaacauguacgcggacgacaccgccggcugggacacccgcaucacggaggacgaccugcagaacgaggccaagaucaccgacaucauggagccggagcacgcccugcucgccaccagcaucuucaagcugaccuaccagaacaagguggugcggguccagcgccccgcgaagaacgggacggugauggacgugaucucccgccgggaccagcgcggcagcgggcaggucggcaccuacggccugaacaccuucaccaacauggaggcccagcucauccggcagauggaguccgaggggaucuuccugcccagcgagcuggagacgcccaaccucgccgagcgcgugcuggacuggcuggagaagcacggcguggagcggcucaagcgcauggccaucuccggggacgacugcgucgugaagccgaucgacgaccgguucgccaccgcgcugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggucccugcgggagaccgccugccucggcaagagcuacgcgcagauguggcagcugauguacuuccaccgccgggaccugcgccucgccgccaacgccaucugcagcgcggugcccgucgacugggugcccacgucccggaccaccuggagcauccacgcccaccaccaguggaugaccacggaggacaugcuguccguguggaaccgcgucuggaucgaggagaaccccuggauggaggacaagacccacgugagcuccuggggcgacgugccguaccuggggaagcgggaggaccaguggugcggcagccucaucggccugaccgcccgcgccaccugggccuccaacauccaggucgcgaucaaccaggugcgccggcugaucgggaacgagaacuaccucgacuacaugaccagcaugaagcgcuucaagaacgagggcgaccccgagggggcccugugguga

SEQ ID NO: 8730 - RNA, 9879 nt, Artificial Sequence
  derived and/or modified CDS sequence (opt1) from DENV-1__EU482794__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacgggguccuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccguggggcugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgcgucccuguucccccucugccugagcacgaccucccagaagaccaccuggcugcccgugcuccugggcagccuggggugcaagccgcucacgauguuccugaucaccgagaccaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucguggugcaggacgacgggaccaugaagaucaaggacgaggagcgggacgacacccugacgauccugcucaaggcgacccugcuggccgucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacacgauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagaccgcccccgggacguucaagacccccgagggcgaggugggcgccaucgcccucgacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucguccgggaggccaucaagcgcaagcuccggacgcugauccuggcccccacccgcgugguggccuccgagauggccgaggcgcucaagggcaugcccauccgcuaccagaccaccgccgucaagagcgagcacacgggcaaggagaucguggaccugaugugccacgccaccuucaccaugcggcugcucucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcugucccggaagaccuucgacaccgaguaccagaagaccaagaacaacgacugggacuacguggugacgaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaacuacaacaaggagggcgaccaguacaucuacauggggcagccccucaacaacgacgaggaccacgcgcacuggaccgaggccaagaugcugcuggacaacaucaacacgcccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacgcagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugaccggcggggugacccuguucuuccucuccggccgggggcugggcaagacgagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccacgaagaaggaccuggggaucggccacguggcgguggagaaccaccaccacgccaccaugcuggacgucgaccuccaccccgccuccgccuggacccuguacgccguggcgaccacgaucaucaccccgaugaugcgccacaccaucgagaacaccacggccaacaucagccugaccgccaucgccaaccaggccgcgauccucauggggcuggacaagggcuggcccaucuccaagauggacaucggcgugccccugcucgcccuggggugcuacagccaggucaacccccugacccucaccgccgccgugcugaugcugguggcgcacuacgccaucaucggcccggggcuccaggccaaggccacgcgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcaccucccagauccuccugaugcgcacgaccugggcccugugcgagagcaucacccucgcgaccggcccccugacgacccugugggagggguccccgggcaaguucuggaacaccaccaucgccgugagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacccgccacgccgucucccggggcacggcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccaccuacggguggaaccuggucaagcuccacuccggcaaggacguguucuucacgccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacgcacgagauguacuggguguccugcgggaccggcaacaucgugagcgccgucaacaugaccucccggaugcugcugaaccgcuucaccauggcccaccgcaagcccacguacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcucacgaagcccugggacgugauccccauggugacccagaucgcgaugaccgacaccacgcccuucggccagcagcgcgucuucaaggagaagguggacacccggaccccgaaggccaagcgcgggaccgcccagaucauggaggugacggcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacacggccggcugggacacccgcaucaccgaggacgaccugcagaacgaggccaagaucaccgacaucauggagccggagcacgcccugcucgccacguccaucuucaagcugaccuaccagaacaagguggugcggguccagcgccccgcgaagaacgggaccgugauggacgugaucagccgccgggaccagcgcggcuccgggcaggucggcaccuacggccugaacacguucaccaacauggaggcccagcucauccggcagauggagagcgaggggaucuuccugcccuccgagcuggagacccccaaccucgccgagcgcgugcuggacuggcuggagaaguacggcguggagcggcucaagcgcauggccaucagcggggacgacugcgucgugaagccgaucgacgaccgguucgccaccgcgcugacggcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggaccacgugguccauccacgcccaccaccaguggaugaccaccgaggacaugcugagcguguggaaccgcgucuggaucgaggagaaccccuggauggaggacaagacccacguguccagcuggggcgacgugccguaccuggggaagcgggaggaccaguggugcggcucccucaucggccugaccgcccgcgccacgugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8731 - RNA, 9879 nt, Artificial Sequence
  derived and/or modified CDS sequence (opt1) from DENV-1__EU482795__SS-prME
agcgugaccaugcugcucaugcugaugcccaccgcccuggccuuccaccucacgacccgcggcggggagccccacaugaucgugagcaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccgcacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucuccgggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcugagcugguucaagaagggguccagcaucggcaagauguucgaggccaccgcccgcggggcccggcgcauggccauccucggcgacacggcgugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccucuccgcggccaucggcaaggccugggaggagggggucugcggcauccggagcgccacccgccuggagaacaucauguggaagcagaucuccaacgagcugaaccacauccuccuggagaacgacaugaaguucaccgugguggucggggacguggccggcauccuggcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacagcuacacccaggugugcgaccaccgccugauguccgcggccaucaaggacagcaaggccgugcacgccgacaugggcuacuggaucgaguccgagaagaacgagaccuggaagcucgcccgggcgagcuucaucgaggucaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacgguggucguggacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucacguggaacgaccugauccggcugugcaucauggucggcgccaacgcgagcgaccgcauggggaugggcaccaccuaccucgcccugauggccaccuucaagaugcgcccgauguucgccgugggccuccuguuccggcgccugacgucccgggaggugcugcuccugaccaucgggcugagccucgucgccuccguggagcugcccaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccaugguccugagcaucgugucccugcucccccugugccugagcacgaccucccagaagaccaccuggcuccccgugcugcugggcagccucgggugcaagccgcugacgauguuccugaucgcggagaacaagaucuggggccgcaagagcuggccccucaacgaggggaucauggccgucggcaucguguccauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgccguccucauguaccaggggaagcgccuggagcccagcugggcguccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagaccagcgagggcgaggucggcgccaucgcccuggacuucaagcccgggacgagcggcucccccaucgugaaccgcgaggggaagaucgugggccuguacggcaacggggucgugaccaccagcggcaccuacguguccgcgaucgcccaggccaaggccagccaggaggggccccucccggagaucgaggacgaggucuuccggaagcgcaaccugacgaucauggaccugcaccccggcuccgggaagacccggcgcuaccuccccgcgaucgugcgggaggccaucaagcgcaagcugcggacccugauccucgccccgacccgcguggucgccagcgagauggccgaggcgcugaagggcaugcccauccgcuaccagacgaccgccgugaaguccgagcacaccggcaaggagaucguggaccugaugugccacgccaccuucacgaugcggcuccugagccccguccgcgugcccaacuacaacaugaucaucauggacgaggcccacuucaccgacccguccagcaucgccgcgcggggguacaucuccacccgcgugggcaugggggaggccgccgccaucuucaugaccgccacgccgcccggcagcgucgaggcguucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcucagccggcgcaccuucgacacggaguaccagaagaccaagaacaacgacugggacuacguggucaccaccgacaucuccgagaugggcgccaacuuccgggcggaccgcgugaucgacccccggcgcugccugaagccggugauccugaaggacgggcccgagcgggucauccucgccggccccaugcccgugacggucgccagcgccgcccagcgccgggggcgcaucggccggaaccacaacaaggagggcgaccaguacaucuacauggggcagccgcugaacaacgacgaggaccacgcgcacuggaccgaggccaagaugcugcucgacaacaucaacacccccgagggcaucauccccgcccuguucgagcccgagcgcgagaaguccgccgccaucgacggggaguaccgccugcggggcgaggcgcgcaagaccuucguggagcucaugcggcgcggggaccugccgguguggcuguccuacaaggucgccagcgagggcuuccaguacuccgaccggcgcuggugcuucgacggcgagcggaacaaccaggugcucgaggagaacauggacguggagaucuggacgaaggagggggagcgcaagaagcugcggccccgcuggcuggacgcccggaccuacagcgacccccucgcccugcgcgaguucaaggaguucgccgcgggccggcgcuccgucagcggggaccugauccucgagaucggcaagcugccccagcaccugacccagcgggcccagaacgcccucgacaaccuggugaugcugcacaacuccgagcagggcgggcgcgccuaccggcacgcgauggaggagcucccggacaccaucgagacgcugaugcugcucgcccugaucgccgugcugaccggcggggucacccucuucuuccugagcggccgcgggcugggcaagaccuccaucggccuccugugcgugauggccagcuccgcccugcucuggauggcgagcguggagccccacuggaucgccgccuccaucauccuggaguucuuccugaugguccuccugauccccgagcccgaccggcagcgcaccccgcaggacaaccagcuggccuacguggugaucgggcuccuguucaugauccugacggucgccgcgaacgagaugggccuccuggagaccaccaagaaggaccuggggaucggccacguggccguggagaaccaccaccacgccgccaugcucgacgucgaccugcaccccgccagcgcguggacccuguacgccguggccacgaccaucaucacccccaugaugcggcacaccaucgagaacacgaccgccaacaucucccucaccgccaucgcgaaccaggccgccauccugauggggcuggacaagggcuggccgaucagcaagauggacaucggcgugccccuccuggcccuggggugcuacucccaggucaacccccucacccugacggcggccgugcugaugcucguggcccacuacgccaucaucggccccgggcugcaggccaaggcgacccgcgaggcccagaagcgcaccgccgccggcaucaugaagaacccgaccgucgacgggaucguggccaucgaccuggaccccguggucuacgacgcgaaguucgagaagcagcucggccagaucaugcugcugauccucugcacgagccagauccugcugaugcggaccaccugggcccucugcgaguccaucacccuggccacgggcccccugaccacccucugggaggggagccccggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggcgaaggagggccugaagcgcggggagacgaccaagcacgccgucagccggggcaccgccaagcuccgcugguucguggagcggaaccuggugaagccggaggggaaggucaucgaccugggcugcggccgcgggggcugguccuacuacugcgccgggcugaagaaggugaccgaggugaagggcuacacgaagggcgggcccggccacgaggagcccauccccauggccaccuacggguggaaccucgucaagcugcacagcggcaaggacguguucuucaucccgcccgagaagugcgacacccugcucugcgacaucggggaguccagccccaaccccaccaucgaggagggccggacgcugcgcgugcugaagauggucgagccguggcuccgggggaaccaguucugcaucaagauccugaaccccuacaugcccuccgugguggagacccuggagcagaugcagcgcaagcacggcggcaugcucguccggaacccccugagccgcaacuccacccacgagauguacugggugagcugcgggaccggcaacaucguguccgcggucaacaugaccagccggaugcugcucaaccgcuucacgauggcccaccgcaagccgaccuacgagcgggacguggaccugggggccggcacccgccacguggccgucgagcccgagguggccaaccuggacaucaucggccagcggaucgagaacaucaagcacgagcacaaguccaccuggcacuacgacgaggacaaccccuacaagacgugggcguaccacgggagcuacgaggugaagcccagcggcuccgccagcuccauggucaacgggguggucaagcuccugaccaagccgugggacgugauccccauggugacccagaucgccaugaccgacacgacccccuucggccagcagcgcgucuucaaggagaagguggacacccggacccccaaggccaagcgcgggacggcccagaucauggaggugaccgcgaaguggcuguggggcuuccucagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcggggucgagggcgaggggcugcacaagcucggcuacauccugcgggacaucuccaagauccccgggggcaacauguacgccgacgacaccgccggcugggacacccgcaucaccgaggacgaccugcagaacgaggccaagaucacggacaucauggagcccgagcacgcgcuccuggccaagagcaucuucaagcugaccuaccagaacaagguggugcggguccagcgcccggccaagaacgggaccgugauggacgugaucucccgccgggaccagcgcggcagcgggcaggucggcaccuacggccucaacacguucaccaacauggaggcccagcugauccggcagauggaguccgaggggaucuucagccccuccgagcuggagacccccaaccucgccggccgcgugcuggacuggcuggagaagcacgggguggagcggcucaagcgcauggcgaucagcggcgacgacugcgucgugaagcccaucgacgaccgguucgccaccgcccugacggcccugaacgacauggggaaggugcgcaaggacaucccgcagugggagcccagcaagggcuggaacgacuggcagcagguccccuucugcucccaccacuuccaccagcucaucaugaaggacggccgggagaucguggugcccugccgcaaccaggacgagcuggucgggcgggcccgcgugagccagggcgcgggguggucccugcgggagaccgccugccucggcaagagcuacgcccagauguggcagcugauguacuuccaccgccgggaccugcgccucgccgcgaacgccaucugcuccgccgugccggucgacugggugcccaccagccggaccacgugguccauccacgcccaccaccaguggaugaccaccgaggacaugcugagcguguggaaccgcgucuggaucgaggagaaccccuggauggaggacaagacccacaucuccagcuggggcgacgugcccuaccugggcaagcgggaggaccaguggugcggcucccucaucgggcugacggcccgcgcgaccugggccaccaacauccagguggccaucaaccagguccgccggcugaucggcaacgagaacuaccucgacuacaugaccagcaugaagcgcuucaagaacgaguccgacccggagggggcccugugguga

SEQ ID NO: 8732 - RNA, 9879 nt, Artificial Sequence
  derived and/or modified CDS sequence (opt1) from DENV-1__EU482796__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccugcgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgucgggcuccuguuccggcgccugacgucccgggaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccauggugcucagcaucgucucccugaucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcggacccucauccuggcccccacccgcguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccaccaugcuggacguggaccugcaccccgccuccgccuggacgcucuacgccguggcgaccaccaucaucaccccgaugaugcgccacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgggaggcccagaagcgcaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcgcaccaccugggcccugugcgagagcaucacgcuggcgaccggcccccucaccacccugugggagggguccccgggcaaguucuggaacacgaccaucgccgugagcauggccaacaucuuccggggguccuaccuggccggcgccggccucgcguucagccugaugaagucccucgggggcgggcgccgggggaccggggcccagggcgagacccucggcgagaaguggaagcgccagcugaaccagcuguccaagagcgaguucaacaucuacaagcgguccgggaucauggaggucgaccgcagcgaggccaaggagggccucaagcgcggggagacgacccgccacgccgugucccggggcaccgcgaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucacgccgcccgagaagugcgacacccuccugugcgacaucggggagagcucccccaacccgacgaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgccgugaacaugacgucccggaugcuccugaaccgcuucaccauggcccaccgcaagcccaccuacgagaaggacguggaccugggggcgggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcugcugaccaagcccugggacgugauccccauggucacccagaucgcgaugacggacaccacccccuucggccagcagcggguguucaaggagaagguggacacccgcacgccgaaggccaagcgggggaccguccagaucauggaggugaccgcccgcuggcucuggggcuuccugucccggaacaagaagccccgcaucugcacccgggaggaguucacgcgcaaggugcggagcaacgccgccaucggcgcggucuucguggacgagaaccaguggaacuccgccaaggaggccguggaggacgagcgcuucugggaccuggucaagaaggagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgcgggcugggacacccggaucacggaggacgaccuccagaacgaggccaagaucaccgacaucauggagccggagcacgcccugcuggccaccuccaucuucaagcucaccuaccagaacaaggucgugcgcgugcagcggcccgccaagaacgggacggucauggacgugaucagccgccgcgaccagcggggcuccggccaggugggcaccuacggccugaacaccuucaccaacauggaggcgcagcugauccgccagauggagagcgaggggaucuuccuccccuccgagcuggagacgcccaaccuggccgagcggguccucgacuggcuggagaaguacggcguggagcgccugaagcggauggccaucagcggggacgacugcguggucaagccgaucgacgaccgcuucgccaccgcccucaccgcgcugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcccgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccugguccauccacgcgcaccaccaguggaugaccacggaggacaugcucagcguguggaaccggguguggaucgaggagaaccccuggauggaggacaagacccacgucuccagcuggggcgacgugccguaccuggggaagcgcgaggaccaguggugcggcucccugaucggccucaccgcccgggccaccugggccagcaacauccagguggccaucaaccagguccgccgccugaucgggaacgagaacuaccuggacuacaugaccuccaugaagcgguucaagaacgagggcgaccccgagggggcgcucugguga

SEQ ID NO: 8733 - RNA, 9879 nt, Artificial Sequence
  derived and/or modified CDS sequence (opt1) from DENV-1__EU482797__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucacggcccugaacgacauggggaagguccggaaggacgugccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagaccgccugccugggcaaguccuacgcccagauguggcagcucauguacuuccaccggcgcgaccugcggcuggccgcgaacgccaucugcagcgccgugccgguggacuggguccccaccucccgcaccacguggagcauccacgcccaccaccaguggaugaccaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucacggcccgggcgaccugggccaccaacauccagguggccaucaaccaggugcgccgccugaucggcaacgagaacuaccuggacuacaugaccuccaugaagcgguucaagaacgagagcgacccggagggggcccucugguga

SEQ ID NO: 8734 - RNA, 9879 nt, Artificial Sequence
  derived and/or modified CDS sequence (opt1) from DENV-1__EU482799__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgugaucggcaccagcaucacccagaaggggaucaucuucauccuccugaugcuggucacgcccuccauggcgaugcggugcgugggcaucggcagccgcgacuucguggaggggcucuccggcgccaccugggucgacguggugcuggagcacgggagcugcgucaccaccauggccaaggacaagcccacgcuggacaucgagcuccugaagaccgaggugaccaaccccgccgugcugcggaagcucugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacacgggcgaccagcaccaggucgggaacgaguccaccgagcacggcaccaccgccaccaucacgccccaggcccccaccaccgagauccagcucaccgacuacggggcgcugacgcuggacugcagcccccgcaccggccucgacuucaacgagauggugcugcugaccaugaaggagaaguccuggcucgugcacaagcagugguuccuggaccugccccuccccuggaccagcggggccagcacgucccaggagaccuggaaccggcaggaccugcuggucaccuucaagaccgcccacgccaagaagcaggagguggugguccucggcagccaggagggcgccaugcacacggcgcugaccggggccaccgagauccagaccuccggcacgaccaccaucuucgccgggcaccugaagugccgccucaagauggacaagcugacccugaagggcaugagcuacgugaugugcacgggguccuucaagcucgagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucaucaucggcgccggcgagaagacgcugaagcucagcugguucaagaagggguccagcaucggcaagauguucgaggccaccgcgcgcggggcccggcgcauggccauccugggcgacaccgccugggacuucggguccaucggcggcguguucaccagcgucgggaagcuggugcaccagaucuucggcacggccuacggggugcuguucuccggcgucagcuggaccaugaagaucgggaucggcgugcugcugaccuggcucggccugaacucccgcagcaccucccugagcaugacgugcaucgcgguggggcucgucacccuguaccugggcgugauggugcaggccgacuccgggugcgucaucaacuggaagggccgggagcucaagugcgggagcggcaucuucgugaccaacgagauccacaccuggaccgagcaguacaaguuccaggccgacagcccgaagcgccuguccgccgccaucggcaaggcgugggaggagggggugugcggcauccggagcgccacgcgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacagcuacacccaggucugcgaccaccgccucauguccgccgccaucaaggacagcaaggcggugcacgccgacaugggcuacuggaucgaguccgagaagaacgagacguggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacccagacggccggccccuggcaccuggggaagcuggagcucgacuucgaccugugcgagggcaccaccgugguggucgacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgcgggcagcggcgagguggacuccuucagccucgggcugcugugcaucuccaucaugaucgaggaggucaugcggagccgcuggucccggaagaugcucaugacgggcacccuggccguguucuuccugcucaucauggggcagcugaccuggaacgaccugauccgccucugcaucauggugggcgccaacgccagcgaccgcauggggaugggcaccacguaccuggcccugauggcgaccuucaagaugcggccgauguucgccgucggccuccuguuccgccggcugaccucccgcgaggugcuccugcugaccaucgggcucagccugguggccuccgucgagcugcccaacagccucgaggagcugggcgacgggcuggccaugggcaucaugauccucaagcugcugacggacuuccagucccaccagcucugggccacccugcugagccucaccuucaucaagaccacguucucccugcacuacgcguggaagaccauggccauggugcugagcaucgucucccucuucccccugugccugagcaccaccucccagaagacgaccuggcuccccgugcugcugggcagccucgggugcaagccgcugaccauguuccugaucgccgagaacaagaucuggggccggcgcuccuggccccucaacgaggggaucauggccgugggcaucgucagcauccugcugagcucccuccugaagaacgacgugccccuggcggggccccucaucgccggcggcaugcugaucgccugcuacgugaucagcggguccagcgccgaccugucccucgagaaggccgcggaggucagcugggaggaggaggccgagcacuccggcgccagccacaacauccugguggaggugcaggacgacgggaccaugaagaucaaggacgaggagcgggacgacacccugacgauccuccugaaggccacccugcucgccgucuccggcguguacccgcugagcauccccgcgacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacacgauguggcacgugacccggggcgccgugcucauguaccaggggaagcgccuggagcccagcugggccuccgucaagaaggaccugaucagcuacggcggcggguggcggcuccagggcuccuggaacaccggggaggagguccaggugaucgccgucgagcccggcaagaaccccaagaacgugcagaccgcgcccgggacguucaagacccccgagggcgaggugggcgccaucgcccuggacuucaagcccgggaccagcggcucccccaucgucaaccgcgaggggaagaucgugggccuguacggcaacgggguggucaccacgagcggcaccuacgugagcgccaucgcccaggcgaaggccucccaggaggggccgcuccccgagaucgaggacgagguguuccggaagcgcaaccugaccaucauggaccugcaccccggcagcgggaagacccggcgcuaccucccggccaucguccgggaggccaucaagcgcaagcugcgcacgcugauccucgcgcccacccgggugguggccuccgagauggccgaggcccugaagggcaugcccauccgcuaccagaccaccgccgucaagagcgagcacacgggcaaggagaucguggaccugaugugccacgcgaccuucaccaugcggcuccugucccccgugcgcgucccgaacuacaacaugaucaucauggacgaggcccacuucaccgaccccagcuccaucgccgcccggggguacaucagcacgcgcgugggcaugggggaggccgcggccaucuucaugaccgccacgccgcccggcuccguggaggccuucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgcgaacugccugcggaagaacgggaagcgcgucauccagcucucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccugaaggacgggcccgagcgcgugauccucgccggccccaugccggucaccguggcguccgccgcccagcggcgcgggcggaucggccgcaaccacaacaaggagggcgaccaguacaucuacauggggcagccccugaacaacgacgaggaccacgcccacuggaccgaggccaagaugcugcucgacaacaucaacacgcccgagggcaucauccccgcgcuguucgagccggagcgcgagaaguccgccgccaucgacggggaguaccggcugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcgcgcaccuacuccgacccccucgcccugcgggaguucaaggaguucgccgccggccgccggagcguguccggggaccugauccucgagaucggcaagcugccgcagcaccugacgcagcgcgcccagaacgcgcucgacaaccuggucaugcugcacaacagcgagcagggcgggcgggccuaccgccacgccauggaggagcuccccgacaccaucgagacccugaugcugcucgcccugaucgcggugcugaccggcggggugacccucuucuuccuguccggccgggggcugggcaagacgagcaucggccuccugugcgucauggccuccagcgugcugcucuggauggccuccguggagccccacuggaucgccgccagcaucauccuggaguucuuccugaugguccuccugauccccgagccggaccgccagcggacgccccaggacaaccagcuggcguacguggugaucgggcuccuguucaugauccugaccgucgccgccaacgagaugggccuccuggagaccacgaagaaggaccuggggaucggccacguggccguggagaaccaccaccacgccgcgaugcucgacgucgaccugcaccccgccuccgccuggacccuguacgccguggccaccaccaucaucacgccgaugaugcgccacaccaucgagaacaccaccgcgaacaucagccucacggccaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgcgaucaucggcccggggcugcaggccaaggccacccgcgaggcccagaagcggacggccgcgggcaucaugaagaaccccaccgucgacgggaucguggccaucgaccuggaccccguggucuacgacgccaaguucgagaagcagcucggccagaucaugcugcugauccucugcaccucccagauccugcugaugcgcaccacgugggcccucugcgagagcaucacccuggccaccggcccccugaccacgcucugggagggguccccgggcaaguucuggaacaccaccaucgcggugagcauggccaacaucuuccggggguccuaccuggccggcgccggccuggccuucagccucaugaagucccucgggggcgggcgccgggggaccggggcgcagggcgagacgcugggcgagaaguggaagcgccagcucaaccagcuguccaagagcgaguucaacaccuacaagcgguccgggaucauggagguggaccgcagcgaggccaaggagggccugaagcgcggggagaccaccaagcacgccgucucccgcggcacggccaagcuccggugguucguggagcgcaaccuggugaagcccgaggggaaggucaucgaccugggcugcggccgcgggggcuggagcuacuacugcgcggggcugaagaaggugaccgaggugaagggcuacaccaagggcggccccggccacgaggagcccaucccgauggccaccuacggguggaaccucgucaagcugcacuccggcaaggacguguucuucaucccgcccgagaagugcgacacgcugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggacgggcaacaucgugagcgccgucaacaugaccucccgcaugcugcucaaccgcuucaccauggcccaccggaagcccaccuacgagcgcgacguggaccugggggccggcacgcggcacguggcggucgagcccgagguggccaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugaccaagcccugggacgugauccccauggugacgcagaucgccaugaccgacaccacccccuucggccagcagcgggucuucaaggagaagguggacacgcgcaccccgaaggcgaagcgggggaccgcccagaucauggaggugaccgccaaguggcuguggggcuuccucucccgcaacaagaagccccggaucugcacgcgcgaggaguucacccggaagguccgcagcaacgccgccaucggcgcgguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggcgaaggggagccgggccaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgcgggcugggacacgcggaucaccgaggacgaccugcagaacgaggcccgcaucaccgacaucauggagccggagcacgcccuccuggccaaguccaucuucaagcugaccuaccagaacaagguggugcgcguccagcggcccgccaagaacgggacggugauggacgugaucagccgccgggaccagcgcggcuccgggcaggucggcaccuacggccucaacaccuucaccaacauggaggcgcagcugauccggcagauggagagcgaggggaucuucucccccagcgagcuggagacgcccaaccucgccgagcgcgugcuggacuggcuggagaaguacggcguggagcggcucaagcgcauggccaucuccggggacgacugcgucgugaagccgaucgacgaccgguucgccaccgcccugaccgcgcugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgccugccucgggaaguccuacgcccagauguggcagcugauguacuuccaccgccgggaccugcgccucgcggccaacgccaucugcagcgccgugcccgucgacuggauccccacgucccggaccaccuggagcauccacgcgcaccaccaguggaugaccacggaggacaugcuguccguguggaaccgcguguggaucgaggagaaccccuggauggaggacaagacccacaucagcuccuggggcgacgucccguaccuggggaagcgcgaggaccaguggugcggcagccucaucggccugaccgcccgggccaccugggccaccaacauccagguggccaucaaccaggugcgccggcugaucgggaacgagaacuaccucgacuacaugacguccaugaagcgcuucaagaacgagagcgaccccgagggcgcgcugugguga

SEQ ID NO: 8735 - RNA, 9879 nt, Artificial Sequence
  derived and/or modified CDS sequence (opt1) from DENV-1__EU482800__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggccagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccaucgacagccgcugcccgacgcagggcgaggccacccucguggaggagcaggacgccaacuucgucugccggcgcaccuucguggaccggggcugggggaacggcugcgggcuguucggcaaggggucccugaucacgugcgccaaguucaagugcgugacgaagcucgagggcaagaccguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgugacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgccaacgcguccgaccgcauggggaugggcacgaccuaccucgcccugauggccaccuucaagaugcgcccgauguucgccgugggccuccuguuccggcgccugaccagccgggagguccugcuccugacgaucgggcugucccucguggccagcgucgagcugcccaacucccuggaggagcucggcgacgggcuggcgaugggcaucaugauccugaagcuccugaccgacuuccagagccaccagcugugggccacccuccugucccugaccuucaucaagacgaccuucagccuccacuacgccuggaagaccauggccauggugcuguccaucgugagccuguucccccucugccuguccaccacgagccagaagaccaccuggcugcccguccuccugggcucccuggggugcaagccgcucaccauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggacgaugaagaucaaggacgaggagcgggacgacacccugaccauccugcucaaggcgacccugcuggccgugagcggcgucuacccgcucuccauccccgccacccuguucgugugguacuucuggcagaagaagaagcagcgcagcggggugcugugggacacgcccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgccgugcugauguaccaggggaagcgccucgagcccuccugggcgagcgugaagaaggaccugaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcccucgacuucaagcccgggaccagcggcagccccaucgugaaccgcgaggggaagaucgucggccuguacggcaacgggguggugacgaccuccggcaccuacgucagcgcgaucgcccaggccaaggccucccaggaggggccccugccggagaucgaggacgagguguuccggaagcgcaaccucaccaucauggaccugcaccccggcagcgggaagacgcggcgcuaccugcccgcgaucgugcgggaggccaucaagcgcaagcuccggacccugauccuggccccgacccgcgucguggccuccgagauggccgaggcgcucaagggcaugcccauccgcuaccagaccacggccgucaagagcgagcacaccggcaaggagaucgucgaccugaugugccacgccaccuucaccaugcggcugcucucccccgugcgcgugcccaacuacaacaugaucaucauggacgaggcccacuucacggacccgagcuccaucgccgcgcggggguacaucagcacccgcgucggcaugggggaggccgccgccaucuucaugaccgccacgccgcccggcuccguggaggcguucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccugcggaagaacgggaagcgcgugauccagcugucccggaagaccuucgacaccgaguaccagaagacgaagaacaacgacugggacuacgucgugaccaccgacaucagcgagaugggcgccaacuuccgcgcggaccgggugaucgacccccgccggugccucaagccggucauccugaaggacgggcccgagcgcgugauccuggccggccccaugcccgucaccguggccuccgccgcccagcggcgcgggcggaucggccgcaaccacaacaaggagggcgaccaguacaucuacauggggcagccgcucaacaacgacgaggaccacgcgcacuggacggaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacccucaugcugcuggcccucaucgccguccugacgggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagcccgaccgccagcggaccccgcaggacaaccagcuggccuacgucgugaucgggcuccucuucaugauccugaccguggccgccaacgagaugggccugcucgagacgaccaagaaggaccuggggaucggccacgucgcgguggagaaccaccaccacgccgccaugcuggacguggaccuccaccccgccuccgccuggacccuguacgcggucgccaccacgaucaucacccccaugaugcgccacaccaucgagaacaccacggccaacaucagccugaccgccaucgccaaccaggcggccauccucauggggcuggacaagggcuggccgaucuccaagauggacaucggcgugccccugcucgcccuggggugcuacagccaggugaacccccugacccucaccgccgcgguccugaugcugguggcccacuacgccaucaucggccccgggcuccaggccaaggccacgcgggaggcgcagaagcgcaccgccgccggcaucaugaagaacccgaccguggacgggaucgucgccaucgaccuggaccccgugguguacgacgccaaguucgagaagcagcugggccagaucaugcuccugauccugugcaccucccagauccuccugaugcgcacgaccugggcgcugugcgagagcaucacccucgccaccggcccccugacgacccugugggaggggucccccggcaaguucuggaacaccaccaucgccgucagcauggccaacaucuuccgggggagcuaccucgccggcgcgggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgcggugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcgggcccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgccgugaacaugaccucccgcaugcugcugaaccgguucaccaugguccaccgcaagccgacguacgagcgcgacguggaccucggggcgggcacccggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggucaagcccagcggcagcgccuccagcauggugaacgggguggucaagcugcucacgaagccgugggacgugauccccauggugacccagaucgcgaugaccgacaccacgcccuucggccagcagcgggucuucaaggagaagguggacacccgcacccccaaggccaagcgggggaccgcccagaucauggaggugacggccaaguggcuguggggcuuccugucccgcaacaagaagccgcggaucugcacccgcgaggaguucacccggaagguccgcagcaacgccgcgaucggcgccguguucguggacgagaaccaguggaacuccgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacacggccggcugggacacccggaucaccgaggacgaccugcagaacgaggccaagaucaccgacaucauggagcccgagcacgcccugcucgccaaguccaucuucaagcugacguaccagaacaagguggugcgcguccagcggccggcgaagaacgggaccgugauggacgugaucagccgccgcgaccagcggggcuccgggcaggucggcaccuacggccugaacaccuucacgaacauggaggcccagcucauccgccagauggagagcgaggggaucuucucccccagcgagcuggagacccccaaccuggccggccggguguucgacuggcucgagaagcacgggguggagcgccugaagcggauggccaucuccggcgacgacugcgucgugaagcccaucgacgaccgcuucgccaccgcgcugaccgcccucaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcuggucgggcgcgcccgggugucccagggcgccggguggagccuccgcgagacggccugccugggcaaguccuacgcgcagauguggcagcugauguacuuccaccggcgcgaccuccggcuggccgccaacgccaucugcagcgcggugccggucgacugggugcccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugcccuaccucggcaagcgcgaggaccaguggugcggcagccugaucgggcugaccgcccgggccacgugggccaccaacauccagguggcgaucaaccagguccgccgccucaucggcaacgagaacuaccuggacuacaugaccuccaugaagcgguucaagaacgagagcgacccggagggggcccugugguga

SEQ ID NO: 8736 - RNA, 9879 nt, Artificial Sequence
  derived and/or modified CDS sequence (opt1) from DENV-1__EU482801__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaacauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacggcaccgugauggacgucaucagccgccgggaccagcgcggguccggccaggugggcacguacgggcucaacaccuucaccaacauggaggcccagcugauccggcagauggagagcgagggcaucuucucccccagcgagcuggagacccccaaccucgccgagcgcgugcuggacuggcuggagaaguacggggucgagcggcucaagcgcauggccaucuccggcgacgacugcguggugaagccgaucgacgaccgguucgcgacggcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgcgugccucggcaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgcgaggaccaguggugcggcagccucaucgggcugaccgcccgggccaccugggcgaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8737 - RNA, 9879 nt, Artificial Sequence
  derived and/or modified CDS sequence (opt1) from DENV-1__EU482802__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccgcacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccugcucccccugugccuguccacgaccagccagaagaccaccuggcuccccgugcugcugggcucccucgggugcaagccgcugacgauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgggacgacacccugaccauccuccugaaggccacccugcucgccgugagcggcguguacccgcuguccauccccgccacgcuguucgucugguacuucuggcagaagaagaagcagcgcagcggggugcucugggacacccccagcccgcccgagguggagcgggccguccuggacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacacgggggaggaggugcaggucaucgccguggagcccggcaagaaccccaagaacgugcagaccgcccccgggaccuucaagaccuccgagggcgaggucggcgccaucgcgcuggacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccucccggagaucgaggacgaggucuuccggaagcgcaaccugacgaucauggaccugcaccccggcagcgggaagacccggcgcuaccuccccgccaucgugcgggaggccaucaagcgcaagcugcggacccugauccucgccccgacccgcguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcucucccggcgcaccuucgacacggaguaccagaagaccaagaacaacgacugggacuacguggucaccaccgacaucagcgagaugggcgcgaacuuccgggccgaccgcgugaucgacccccggcgcugccugaagccggugauccugaaggacgggcccgagcgggucauccucgccggccccaugcccgugacggucgccuccgccgcgcagcgccgggggcgcaucggccggaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccgccugcggggcgaggcccgcaagaccuucguggagcucaugcggcgcggggaccugccgguguggcugagcuacaaggucgccuccgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccccagcaccugacccagcgggcccagaacgcccucgacaaccuggugaugcugcacaacagcgagcagggcgggcgcgcguaccggcacgccauggaggagcucccggacaccaucgagacgcugaugcugcucgcccugaucgccgugcugaccggcggggucacccucuucuuccuguccggccgcgggcugggcaagaccagcaucggccuccugugcgugauggccuccagcgcgcugcucuggauggccuccguggagccccacuggaucgccgccagcaucauccuggaguucuuccugaugguccuccugauccccgagcccgaccggcagcgcaccccgcaggacaaccagcuggccuacguggugaucgggcuccuguucaugauccugacggucgcggccaacgagaugggccuccuggagaccaccaagaaggaccuggggaucggccacguggccguggagaaccaccaccacgccgccaugcucgacgucgaccugcaccccgcguccgccuggacccuguacgccguggccacgaccaucaucacccccaugaugcggcacaccaucgagaacacgaccgccaacaucagccucaccgcgaucgccaaccaggccgccauccugauggggcuggacaagggcuggccgaucuccaagauggacaucggcgugccccuccuggcgcuggggugcuacagccaggucaacccccucacccugacggccgccgugcugaugcucguggcccacuacgccaucaucggccccgggcugcaggcgaaggccacccgcgaggcccagaagcgcaccgccgccggcaucaugaagaacccgaccgucgacgggaucguggcgaucgaccuggaccccguggucuacgacgccaaguucgagaagcagcucggccagaucaugcugcugauccucugcacgucccagauccugcugaugcggaccaccugggcccucugcgagagcaucacccuggccacgggcccccugaccacccucugggaggggucccccggcaaguucuggaacaccacgaucgccgugagcauggcgaacaucuuccgcgggagcuaccuggccggcgccggccuggccuucucccucaugaagucccucgggggcgggcggcgcgggaccggggcgcagggcgagacccugggcgagaaguggaagcggcagcucaaccagcuguccaagagcgaguucaacaccuacaagcgcuccgggaucauggagguggaccggagcgaggccaaggagggccugaagcgcggggagacgaccaagcacgccgucucccggggcaccgccaagcuccgcugguucguggagcggaaccuggugaagccggaggggaaggucaucgaccugggcugcggccgcgggggcuggagcuacuacugcgccgggcugaagaaggugaccgaggugaagggcuacacgaagggcgggcccggccacgaggagcccauccccauggcgaccuacggguggaaccucgucaagcugcacuccggcaaggacguguucuucaucccgcccgagaagugcgacacccugcucugcgacaucggggagagcucccccaaccccaccaucgaggagggccggacgcugcgcgugcugaagauggucgagccguggcuccgggggaaccaguucugcaucaagauccugaaccccuacaugcccagcgugguggagacccuggagcagaugcagcgcaagcacggcggcaugcucguccggaacccccugucccgcaacagcacccacgagauguacuggguguccugcgggaccggcaacaucgugagcgccgucaacaugaccucccggaugcugcucaaccgcuucacgauggcccaccgcaagccgaccuacgagcgggacguggaccugggggccggcacccgccacguggccgucgagcccgagguggcgaaccuggacaucaucggccagcggaucgagaacaucaagcacgagcacaagagcaccuggcacuacgacgaggacaaccccuacaagacgugggccuaccacggguccuacgaggugaagcccagcggcagcgccuccagcauggucaacgggguggucaagcuccugaccaagccgugggacgugauccccauggugacccagaucgccaugaccgacacgacccccuucggccagcagcgcgucuucaaggagaagguggacacccggacccccaaguccaagcgcgggacggcccagaucauggaggugaccgcgaaguggcuguggggcuuccucagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcggggucgagggcgaggggcugcacaagcucggcuacauccugcgggacaucuccaagauccccgggggcaacauguacgccgacgacaccgccggcugggacacccgcaucaccgaggacgaccugcagaacgaggccaagaucacggacaucauggagcccgagcacgcgcuccuggccaagagcaucuucaagcugaccuaccagaacaagguggugcggguccagcgcccggccaagaacgggaccgugauggacgugaucucccgccgggaccagcgcggcagcgggcaggucggcaccuacggccucaacacguucaccaacauggaggcccagcugauccggcagauggaguccgaggggaucuucagccccuccgagcuggagacccccaaccucgccggccgcgugcuggacuggcuggagaagcacgggguggagcggcucaagcgcauggcgaucagcggcgacgacugcgucgugaagcccaucgacgaccgguucgccaccgcccugacggcccugaacgacauggggaaggugcgcaaggacaucccgcagugggagcccagcaagggcuggaacgacuggcagcagguccccuucugcucccaccacuuccaccagcucaucaugaaggacggccgggagaucguggugcccugccgcaaccaggacgagcuggucgggcgggcccgcgugagccagggcgcgggguggucccugcgggagaccgccugccucggcaagagcuacgcccagauguggcagcugauguacuuccaccgccgggaccugcgccucgccgcgaacgccaucugcuccgccgugccggucgacugggugcccaccagccggaccacgugguccauccacgcccaccaccaguggaugaccaccgaggacaugcugagcguguggaaccgcgucuggaucgaggagaaccccuggauggaggacaagacccacaucuccagcuggggcgacgugcccuaccugggcaagcgggaggaccaguggugcggcucccucaucgggcugacggcccgcgcgaccugggccaccaacauccagguggccaucaaccagguccgccggcugaucggcaacgagaacuaccucgacuacaugaccagcaugaagcgcuucaagaacgaguccgacccggagggggcccugugguga

SEQ ID NO: 8738 - RNA, 9879 nt, Artificial Sequence
  derived and/or modified CDS sequence (opt1) from DENV-1__EU482804__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaaggucgugcaguacgagaaccugaaguacagcgugaucgucaccgugcacaccggcgaccagcaccaggucgggaacgaguccacggagcacggcaccaccgcgaccaucacgccccaggcccccagcacggagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccagcggggccuccaccagccaggagaccuggaaccggaaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggcggagacccagcacggcacgguccucgugcagaucaaguacgagggcaccgacgcccccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcgucuucacguccguggggaagcuggugcaccagaucuucggcaccgccuacgggguccuguucagcggcguguccuggaccaugaagaucgggaucggcgugcuccugaccuggcugggccucaacagccgcuccacgagccuguccaugaccugcaucgccgucgggcuggugacccucuaccugggcgugaugguccaggccgacagcgggugcgugaucaacuggaagggccgggagcugaagugcgggagcggcaucuucgugaccaacgagguccacacguggaccgagcaguacaaguuccaggcggacuccccgaagcgccucagcgccgccaucggcaaggccugggaggagggggugugcggcauccgguccaccacccgccuggagaacaucauguggaagcagaucagcaacgagcugaaccacauccuccuggagaacgacaugaaguucaccguggucgugggggacguggccggcauccuggcgcaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucacggggcagcucaccuggaacgaccugauccggcugugcaucauggugggcgccaacgcguccgaccgcauggggaugggcaccaccuaccucgcccugauggccacguucaagaugcgcccgauguucgccguggggcuccuguuccggcgccugaccagccgggagguccugcuccugaccaucgggcugucccucguggccagcgucgagcugcccaacucccuggaggagcucggcgacgggcuggcgaugggcaucaugauccugaagcuccugaccgacuuccagagccaccagcugugggccacgcuccugucccugaccuucaucaagaccaccuucagccuccacuacgccuggaagacgauggccauggugcuguccaucgugagccuguucccccucugccuguccaccaccagccagaagaccacguggcugcccguccuccugggcucccuggggugcaagccgcucaccauguuccugaucgcggagaacaagaucuggggccgcaagagcuggccccugaacgaggggaucauggccgugggcaucgugagcauccuccuguccagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacgcugcuggccgugagcggcgucuacccgcucuccauccccgccacccuguucgugugguacuucuggcagaagaagaagcagcgcagcggggugcugugggacacccccagcccgcccgaggucgagcgggccgugcucgacgacggcaucuaccgcaucaugcagcggggccugcuggggcgcagccaggugggcgucgggguguuccaggagaacguguuccacaccauguggcacgucacgcggggcgccgugcugauguaccaggggaagcgccucgagcccuccugggcgagcgugaagaaggaccugaucuccuacggcggcggguggcggcugcagggcagcuggaacaccggggaggagguccaggugaucgccguggagcccggcaagaaccccaagaacguccagaccgcccccgggaccuucaagacguccgagggcgaggugggcgccaucgcccucgacuucaagcccgggaccagcggcagccccaucgugaaccgcgaggggaagaucgucggccuguacggcaacgggguggugaccaccuccggcacguacgucagcgcgaucgcccaggccaaggccucccaggaggggccccugccggagaucgaggacgagguguuccggaagcgcaaccucaccaucauggaccugcaccccggcagcgggaagacccggcgcuaccugcccgcgaucgugcgggaggccaucaagcgcaagcuccggacccugauccuggccccgacgcgcgucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugcccaacuacaacaugaucaucauggacgaggcccacuucaccgacccgagcuccaucgccgcgcggggguacaucagcacccgcgucggcaugggggaggccgccgccaucuucaugacggccacgccgcccggcuccguggaggcguucccccagagcaacgccgugauccaggacgaggagcgggacaucccggagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccccgccggugccucaagccggucauccugaaggacgggcccgagcgcgugauccuggccggccccaugcccgucaccguggccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagacguucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacacgaucgagacccucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagcccgaccgccagcggacgccgcaggacaaccagcuggccuacgucgugaucgggcuccucuucaugauccugaccguggccgccaacgagaugggccugcucgagaccaccaagaaggaccuggggaucggccacgucgcggccgagaaccaccaccacgccgccaugcuggacguggaccuccaccccgccuccgcguggacgcuguacgccguggccaccaccaucaucacccccaugaugcgccacacgaucgagaacaccaccgccaacaucagccugaccgccaucgcgaaccaggccgccauccucauggggcuggacaagggcuggccgaucuccaagauggacaucggcgucccccugcucgcccuggggugcuacagccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccucccagauccuccugaugcgcaccaccugggcccugugcgagagcaucacgcucgccaccggcccccugaccacccugugggaggggucccccggcaaguucuggaacacgaccaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacacguacaagcgguccgggaucauggaggucgaccgcagcgaggcgaaggagggccugaagcgcggggagaccaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugacgucccgcaugcugcugaaccgguucaccauggcccaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccugucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8739 - RNA, 9879 nt, Artificial Sequence
  derived and/or modified CDS sequence (opt1) from DENV-1__EU482806__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccgugggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccuccgccuggacgcuguacgccgucgcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgccgugaacaugacgucccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugucccgcaacaagaagccccggaucugcacccgcgaggaguucacgcggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaaggucgugcgggugcagcgccccgcgaagaacgggacggucauggacgugaucagccgccgggaccagcgcggcuccggccaggugggcaccuacggccugaacaccuucaccaacauggaggcccagcucauccggcagauggagagcgaggggaucuucucccccugcgagcuggagauccccaaccuggccgagcgcguccucgacuggcuggagaaguacggcguggagcggcugaagcgcauggccaucagcggggacgacugcguggucaagccgaucgacgaccgguucgccacggcgcucaccgcccugaacgacaugggcaaggugcgcaaggacgugccccagugggagcccuccaagggguggaacgacuggcagcagguccccuucugcagccaccacuuccaccagcugaucaugaaggacggccgggagaucguggugccgugccgcaaccaggacgagcucgucggccgggcccgcgugucccagggggccggcuggagccugcgggagaccgccugccugggcaagagcuacgcgcagauguggcagcucauguacuuccaccgccgggaccugcgccuggccgccaacgccaucugcuccgcggugcccgucgacugggugcccaccagccggacgaccugguccauccacgcccaccaccaguggaugaccaccgaggacaugcucagcguguggaaccgcgucuggaucgaggagaaccccuggauggaggacaagacgcacguguccagcuggggcgacgugccguaccuggggaagcgggaggaccaguggugcggcucccugaucggccucaccgcccgcgccaccugggccagcaacauccaggucgcgaucaaccaggugcgccggcugaucgggaacgagaacuaccuggacuacaugaccuccaugaagcgcuucaagaacgagggcgaccccgagggggcccucugguga

SEQ ID NO: 8740 - RNA, 9879 nt, Artificial Sequence
  derived and/or modified CDS sequence (opt1) from DENV-1__EU482807__SS-prME
agcgugaccaugcugcucaugcugaugcccaccgcccuggccuuccaccucacgacccgcggcggggagccccacaugaucgugagcaagcaggagcggggcaagagccugcuguucaagaccagcgcgggggugaacaugugcacccucguggccauggaccugggggaguucugcgaggacacgaugaccuacaagugcccccgcaucaccgaggccgagcccgacgacguggacugcuggugcaacgccaccgacacgugggugaccuacgggaccugcagccagaccggggagcaccggcgcgacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggucacccccuccauggccaugcggugcgugggcaucggcagccgcgacuucguggaggggcuguccggcgccacgugggucgacguggugcucgagcacgggagcugcgucaccaccauggccaaggacaagcccacccuggacaucgagcugcucaagacggaggugaccaaccccgcggugcugcggaagcugugcaucgaggccaagaucuccaacaccaccacggacagccgcugcccgacccagggcgaggccacccucgucgaggagcaggacgccaacuucgugugccggcgcaccuucguggaccggggcugggggaacggcugcgggcuguucggcaaggggucccugaucacgugcgccaaguucaagugcgucaccaagcucgagggcaagaccgugcaguacgagaaccugaaguacagcgugaucgucaccgugcacacgggcgaccagcaccaggucgggaacgaguccaccgagcacggcaccaccgcgaccaucacgccccaggcccccagcaccgagauccagcugaccgacuacggggcccucacccuggacugcagcccccgcacgggccuggacuucaacgagauggugcuccugaccaugaaggagaaguccuggcuggugcacaagcagugguuccucgaccugccgcugcccuggaccagcggggccuccaccagccaggagacguggaaccggaaggaccuccuggucaccuucaagaccgcccacgcgaagaagcaggagguggugguccugggcucccaggagggcgccaugcacaccgcccucacgggggccaccgagauccagaccagcggcaccacgaccaucuucgccgggcaccugaagugccgccugaagauggacaagcucacccugaagggcauguccuacgugaugugcaccgggagcuucaagcuggagaaggagguggcggagacgcagcacggcaccguccucgugcagaucaaguacgagggcaccgacgcccccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcgucuucaccuccguggggaagcuggugcaccagaucuucggcaccgccuacgggguccuguucagcggcguguccuggaccaugaagaucgggaucggcgugcuccugacguggcugggccucaacagccgcuccaccagccuguccaugaccugcaucgccgucgggcuggugacccucuaccugggcgugaugguccaggccgacagcgggugcgugaucaacuggaagggccgggagcugaagugcgggagcggcaucuucgugacgaacgagguccacaccuggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggucgugguggacgagcacugcggcaaccgggggccgagccugcgcaccaccaccgucacgggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucaucgggcagcucacguggaacgaccugauccggcugugcaucauggugggcgcgaacgccuccgaccgcauggggaugggcaccaccuaccucgcccugauggccaccuucaagaugcgcccgauguucgccgugggccuccuguuccggcgccugacgagccgggagguccugcuccugaccaucgggcugucccucguggcgagcgucgagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgauggugcuguccaucgugagccuguucccccucugccuguccacgaccagccagaagaccaccuggcugcccguccuccugggcucccuggggugcaagccgcucacgauguuccugaucgccgagaacaagaucuggggccgccggagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggaccaugaagaucaaggacgaggagcgcgacgacacccugaccauccugcucaaggccacccugcuggccgugagcggcgucuacccgcucuccauccccgccacgcuguucgugugguacuucuggcagaagaagaagcagcggagcggggugcugugggacacccccagcccgcccgaggucgagcgcgccgugcucgacgacggcaucuaccggaucaugcagcgcggccugcuggggcggagccaggugggcgucgggguguuccaggagaacguguuccacaccauguggcacgucacccgcggcgcggugcugauguaccaggggaagcggcucgagcccuccugggccagcgugaagaaggaccugaucuccuacggcggcggguggcgccugcagggcagcuggaacacgggggaggagguccaggugaucgccguggagcccggcaagaaccccaagaacguccagaccgcccccgggaccuucaagaccuccgagggcgaggugggcgccaucgcgcucgacuucaagcccgggacgagcggcagccccaucgugaaccgggaggggaagaucgucggccuguacggcaacgggguggugaccaccuccggcaccuacgucagcgccaucgcccaggccaaggcgucccaggaggggccccugccggagaucgaggacgagguguuccgcaagcggaaccucacgaucauggaccugcaccccggcagcgggaagacccgccgguaccugcccgccaucgugcgcgaggccaucaagcggaagcuccgcacccugauccuggccccgacccgcgucguggccuccgagauggcggaggcccucaagggcaugcccauccgguaccagacgaccgccgucaagagcgagcacaccggcaaggagaucgucgaccugaugugccacgccaccuucacgaugcgccugcucucccccgugcgggugcccaacuacaacaugaucaucauggacgaggcccacuucaccgacccgagcuccaucgcggcccgcggguacaucagcacccgggucggcaugggggaggccgccgccaucuucaugaccgcgacgccgcccggcuccguggaggccuucccccagagcaacgccgugauccaggacgaggagcgcgacaucccggagcgguccuggaacagcggguacgaguggaucaccgacuuccccggcaagaccgucugguucgugcccuccaucaagagcggcaacgacaucgccaacugccugcgcaagaacgggaagcgggugauccagcugucccgcaagaccuucgacacggaguaccagaagaccaagaacaacgacugggacuacgucgugaccaccgacaucagcgagaugggcgcgaacuuccgggccgaccgcgugaucgacccccggcgcugccucaagccggucauccugaaggacgggcccgagcgggugauccuggccggccccaugcccgucacgguggccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgccgcgaucgacggggaguaccgccugcggggcgaggcccgcaagaccuucguggagcugaugcggcgcggggaccucccggucuggcugagcuacaagguggccuccgagggcuuccaguacagcgaccggcgcuggugcuucgacggcgagcggaacaaccaggugcuggaggagaacauggacgucgagaucuggacgaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccccagcaccugacccagcgggcccagaacgcccuggacaaccucgugaugcugcacaacagcgagcagggcgggcgcgcguaccggcacgccauggaggagcugccggacaccaucgagacgcucaugcugcuggcccucaucgccguccugaccggcggggugacccuguucuuccucuccggccgcgggcugggcaagaccagcaucggccugcucugcgugauggccuccagcguccugcuguggauggcguccguggagccccacuggaucgccgccagcaucauccucgaguucuuccugauggugcugcucauccccgagcccgaccggcagcgcaccccgcaggacaaccagcuggccuacgucgugaucgggcuccucuucaugauccugacgguggccgcgaacgagaugggccugcucgagaccaccaagaaggaccuggggaucggccacgucgccguggagaaccaccaccacgccgccaugcuggacguggaccuccaccccgccuccgcguggacccuguacgccgucgccacgaccaucaucacccccaugaugcggcacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgcgaggcccagaagcgcaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcggaccaccugggcccugugcgagagcaucacccucgccacgggcccccugaccacccugugggaggggucccccggcaaguucuggaacaccacgaucgccgucagcauggccaacaucuuccgcgggagcuaccucgcgggcgccggccuggccuucucccugaugaagucccucgggggcgggcggcgcggcaccggggcccagggcgagacccugggcgagaaguggaagcggcagcugaaccagcucuccaagagcgaguucaacaccuacaagcgcuccgggaucauggagguggaccggagcgaggcgaaggagggccugaagcgcggggagacgaccaagcacgccgugucccggggcaccgccaagcugcgcugguucgucgagcggaaccucgugaagccggaggggaaggugaucgaccugggcugcggccgcgggggcuggagcuacuacugcgccgggcugaagaaggucaccgaggugaagggcuacacgaagggcgggcccggccacgaggagcccauccccauggccaccuacggguggaaccuggugaagcuccacuccggcaaggacgucuucuucaucccgcccgagaagugcgacacccugcugugcgacaucggggagagcucccccaaccccaccaucgaggagggccggacgcuccgcgugcugaagaugguggagccguggcugcgggggaaccaguucugcaucaagauccucaaccccuacaugcccagcgucguggagacccuggagcgcaugcagcggaagcacggcggcaugcuggugcgcaacccccucucccggaacagcacccacgagauguacugggucuccugcgggaccggcaacaucgugagcgcggugaacaugaccucccgcaugcugcugaaccgcuucacgauggcccaccggaagccgaccuacgagcgcgacgucgaccucggggccggcacccggcacguggccguggagcccgaggucgccaaccuggacaucaucggccagcgcaucgagaacaucaagcacgagcacaagagcaccuggcacuacgacgaggacaaccccuacaagacgugggcguaccacggguccuacgaggugaagcccagcggcagcgccuccagcauggucaacgggguggugaagcugcucaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcgaaguggcuguggggcuuccugucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccucguccaccgcgagcgggagcugcacaagcaggggaagugcgccacgugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggccaagaucacggacaucauggagcccgagcacgcgcugcucgccaaguccaucuucaagcugaccuaccagaacaaggucgugcgcgugcagcgcccggccaagaacgggaccgucauggacgugaucagccggcgcgaccagcggggcuccggccaggugggcaccuacggccugaacacguucaccaacauggaggcccagcucauccgccagauggagagcgaggggaucuucucccccagcgagcuggagacccccaaccuggccggccggguccucgacuggcuggagaagcacgggguggagcgccugaagcggauggcgaucuccggcgacgacugcguggucaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagaccgccugccugggcaaguccuacgcccagauguggcagcucauguacuuccaccggcgcgaccugcggcuggccgcgaacgccaucugcagcgccgugccgguggacuggguccccaccucccgcaccacguggagcauccacgcccaccaccaguggaugaccaccgaggacaugcucuccguguggaaccggguguggaucgaggagaaccccuggauggaggacaagacccacaucagcuccuggggcgacguccccuaccugggcaagcgcgaggaccaguggugcggcagccugaucgggcucacggcccgcgcgaccugggccaccaacauccagguggccaucaaccaggugcggcgccugaucggcaacgagaacuaccuggacuacaugaccuccaugaagcgguucaagaacgagagcgacccggagggggcccucugguga

SEQ ID NO: 8741 - RNA, 9879 nt, Artificial Sequence
  derived and/or modified CDS sequence (opt1) from DENV-1__EU482808__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaccccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugacgucccgcaugcugcugaaccgguucaccauggcccaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccugucccgcgacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8742 - RNA, 9879 nt, Artificial Sequence
  derived and/or modified CDS sequence (opt1) from DENV-1__EU482809__SS-prME
agcgugaccaugcugcugaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccgcuguccauccccgccacccuguucgucugguacuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgggaggggaagaucgugggccuguacggcaacggggucgugacgaccuccggcaccuacgugagcgccaucgcccaggccaaggcgucccaggaggggccccucccggagaucgaggacgaggucuuccgcaagcggaaccugaccaucauggaccugcaccccggcagcgggaagacgcgccgguaccuccccgccaucgugcgcgaggccaucaagcggcgccugcgcacccugauccucgccccgacccggguggucgccuccgagauggcggaggcccugaagggcaugcccauccgcuaccagaccacggccgucaagagcgagcacaccggcaaggagaucguggaccugaugugccacgccaccuucaccaugcggcuccugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcucucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccugaaggacgggcccgagcgcgucauccucgccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacuccgacccccucgcccugcgggaguucaaggaguucgcggccggccgccggagcgucuccggggaccugauccucgagaucggcaagcugccccagcaccugacccagcgcgcccagaacgcccucgacaaccuggugaugcugcacaacagcgagcagggcgggcgggcguaccgccacgccauggaggagcucccggacaccaucgagacccugaugcugcucgcccugaucgccgugcugacgggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagacgaccaagaaggaccuggggaucggccacguggccgucgagaaccaccaccacgccgccaugcucgacguggaccugcaccccgccuccgcguggacccuguacgccguggccaccacgaucaucacccccaugaugcgccacaccaucgagaacaccacggccaacaucagccucaccgccaucgcgaaccaggccgccauccugauggggcuggacaagggcuggccgaucuccaagauggacaucggcgucccccuccuggcccuggggugcuacagccaggugaacccccucacccugaccgcggccgugcugaugcucgucgcccacuacgccaucaucggccccgggcugcaggccaaggcgacgcgcgaggcccagaagcggaccgccgccggcaucaugaagaacccgaccguggacgggaucguggccaucgaccuggaccccgucguguacgacgcgaaguucgagaagcagcucggccagaucaugcugcugauccucugcaccucccagauccugcugaugcgcacgaccugggcccucugcgagagcaucacccuggccaccggcccccugacgacccucugggaggggucccccggcaaguucuggaacaccaccaucgccgugagcauggccaacaucuuccgggggagcuaccuggcgggcgccggccuggccuucucccucaugaagucccucgggggcgggcgccgggggacgggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagaccacgaagcacgccgugucccgcggcaccgccaagcuccggugguucguggagcgcaaccuggucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccucgugaagcugcacuccggcaaggacguguucuucaucccgcccgagaagugcgacacccugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacgcuggagcagaugcagcggaagcacggcggcaugcucgugcgcaacccccugucccggaacagcacccacgagauguacuggguguccugcgggaccggcaacaucgucagcgcggugaacaugaccucccgcaugcugcucaaccgcuucaccauggcccaccggaagccgacguacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcuccugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccucucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacacggccggcugggacacccggaucaccgaggacgaccugcagaacgaggccaagaucaccgacaucauggagcccgagcacgcgcuccuggccaaguccaucuucaagcugacguaccagaacaaggugguccgcgugcagcgcccggccaagaacgggaccgugauggacgucaucagccggcgcgaccagcggggcuccggccaggugggcaccuacggccucaacaccuucacgaacauggaggcccagcugauccgccagauggagagcgaggggaucuucucccccagcgagcuggagacccccaaccucgccggccgggugcuggacuggcuggagaagcacggggucgagcgccucaagcggauggcgaucuccggcgacgacugcguggugaagcccaucgacgaccgcuucgccaccgcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagacggccugccucggcaaguccuacgcccagauguggcagcugauguacuuccaccggcgcgaccugcggcucgccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacgugagcuccuggggcgacguccccuaccugggcaagcgcgaggaccaguggugcggcagccucaucgggcugaccgcccgcgcgacgugggccaccaacauccagguggccaucaaccaggugcggcgccugcucggcaacgagaacuaccuggacuacaugaccuccaugaagcgguucaagaacgagagcgacccggagggggcccugugguga

SEQ ID NO: 8743 - RNA, 9879 nt, Artificial Sequence
  derived and/or modified CDS sequence (opt1) from DENV-1__EU482810__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacgcagaugugcgaccaccgccucaugagcgccgccaucaaggacuccaaggccgugcacgccgacaugggcuacuggaucgagagcgagaagaacgagaccuggaagcuggcgcgggccuccuucaucgaggugaagaccugcaucuggcccaagagccacacccugugguccaacggcguccucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccgugguggucgacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccggcucugcaucauggugggcgcgaacgccuccgaccgcauggggaugggcacgaccuaccuggcccugauggccaccuucaagaugcgcccgauguucgccgucgggcuccuguuccggcgccugaccagccgggaggugcuccugcugacgaucgggcucucccugguggcgagcgucgagcugcccaacucccucgaggagcugggcgacgggcuggccaugggcaucaugauccucaagcugcugaccgacuuccagagccaccagcucugggccacccugcuguccaugaccuucauccgcacgaccuucagccuccacuacgccuggaagaccauggcgauggugcuguccaucgucagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgugggcaucgucagcauccuccuguccagccugcucaagaacgacgugccccuggccgggccccugaucgccggcggcaugcucaucgcgugcuacgugaucuccgggagcuccgccgaccugagccuggagaaggccgccgaggucuccugggaggaggaggccgagcacagcggcgcgucccacaacauccucguggaggugcaggacgacgggacgaugaagaucaaggacgaggagcgcgacgacacccugaccauccugcucaaggccacccugcuggccgucagcggcguguacccgcucuccauccccgccacccuguucgugugguacuucuggcagaagaagaagcagcggagcgggguccugugggacacgcccagcccgcccgaggugcagcgcgccgugcucgacgacggcaucuaccggaucaugcagcgcggccugcuggggcggagccaggucggcguggggguguuccaggagaacgucuuccacaccauguggcacgugacccgcggcgcggugcugauguaccaggggaagcggcucgagcccuccugggccagcgucaagaaggaccugaucuccuacggcggcggguggcgccugcagggcagcuggaacaccggggaggagguccaggugaucgccgucgagcccggcaagaaccccaagaacgugcagacggcccccgggaccuucaagaccuccgagggcgaggugggcgccaucgcgcucgacuucaagcccgggaccagcggcagccccaucgucaaccgggaggggaagaucgugggccuguacggcaacgggguggucacgaccuccggcaccuacgugagcgccaucgcccaggccaaggcgucccaggaggggccccugccggagaucgaggacgagguguuccgcaagcggaaccucaccaucauggaccugcaccccggcagcgggaagacgcgccgguaccugcccgccaucguccgcgaggccaucaagcggaagcuccgcacccugauccuggccccgacccgcgugguggccuccgagauggcggaggcccucaagggcaugcccauccgguaccagaccacggccgucaagagcgagcacaccggcaaggagaucguggaccugaugugccacgccaccuucaccaugcgccugcucucccccgugcggguccccaacuacaacaugaucaucauggacgaggcccacuucacggacccgagcuccaucgcggcccgcggguacaucagcacccgggugggcaugggggaggccgccgccaucuucaugaccgcgacgccgcccggcuccguggaggccuucccccagagcaacgccgucauccaggacgaggagcgcgacaucccggagcgguccuggaacagcggguacgaguggaucacggacuuccccggcaagaccgugugguucgugcccuccaucaagagcggcaacgacaucgccaacugccugcgcaagaacgggaagcgggucauccagcugucccgcaagaccuucgacaccgaguaccagaagacgaagaacaacgacugggacuacguggugaccaccgacaucagcgagaugggcgcgaacuuccgggccgaccgcgucaucgacccccggcgcugccucaagccggugauccugaaggacgggcccgagcgggugauccuggccggccccaugcccgucaccguggccuccgccgcgcagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccgccugcggggcgaggcccgcaagaccuucgucgagcugaugcggcgcggggaccucccgguguggcugagccacaagguggccuccgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggacguacuccgacccccuggcccuccgcgaguucaaggaguucgcggccggccggcgcagcguguccggggaccugauccuggagaucggcaagcucccccagcaccugacccagcgggcccagaacgcccuggacaaccucgucaugcugcacaacagcgagcagggcgggcgcgcguaccggcacgccauggaggagcugccggacaccaucgagacccucaugcugcuggcccucaucgccgugcugacgggcggggugacccuguucuuccucuccggccgcgggcugggcaagaccagcaucggccugcucugcgucauggccuccagcgugcugcuguggauggcguccguggagccccacuggaucgccgccagcaucauccucgaguucuuccugaugguccugcucauccccgagcccgaccggcagcgcaccccgcaggacaaccagcuggccuacguggugaucgggcuccuguucaugauccugaccgucgccgcgaacgagaugggccugcucgagacgaccaagaaggaccuggggaucggccacguggccguggagaaccaccaccacgccgccaugcuggacgucgaccuccaccccgccuccgcguggacccuguacgccguggccaccacgaucaucacccccaugaugcggcacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggucaacccccugacccucaccgcggccgugcugaugcugguggcccacuacgccaucaucggccccgggcuccaggccaaggcgacgcgcgaggcccagaagcgcaccgccgccggcaucaugaagaacccgaccgucgacgggaucguggccaucgaccuggaccccguggucuacgacgcgaaguucgagaagcagcugggccagaucaugcuccugauccugugcaccucccagauccuccugaugcggacgaccugggcccugugcgagagcaucacccucgccaccggcccccugacgacccugugggaggggucccccggcaaguucuggaacaccaccaucgccgugagcauggccaacaucuuccgcgggagcuaccucgcgggcgccggccuggccuucucccugaugaagucccucgggggcucccggcgcgggacgggcgcccagggggagacccugggcgagaaguggaagcggcagcugaaccagcucagcaaguccgaguucaacaccuacaagcgcagcggcaucauggagguggaccgguccgaggcgaaggaggggcugaagcgcggcgagaccacgaagcacgccgucagccgggggaccgccaagcugcgcugguucguggagcggaaccucgugaagccggagggcaaggucaucgaccuggggugcggccgcggcgggugguccuacuacugcgccggccugaagaaggugaccgaggugaagggguacaccaagggcgggcccggccacgaggagcccauccccauggccacguacggcuggaaccuggucaagcuccacagcgggaaggacguguucuucaucccgcccgagaagugcgacacccugcugugcgacaucggcgaguccagccccaaccccaccaucgaggaggggcggacccuccgcgugcugaagauggucgagccguggcugcggggcaaccaguucugcaucaagauccucaaccccuacaugcccuccgugguggagacgcuggagcagaugcagcgcaagcacgggggcaugcugguccggaacccccucagccgcaacuccacccacgagauguacugggugagcugcggcaccgggaacaucguguccgcggucaacaugaccagccggaugcugcugaaccgcuucaccauggcccaccgcaagccgacguacgagcgggacguggaccucggcgccgggacccgccacguggccgucgagcccgagguggccaaccuggacaucaucggccagcggaucgagaacaucaagcacgagcacaaguccaccuggcacuacgacgaggacaaccccuacaagaccugggcguaccacggcagcuacgaggugaagcccagcggguccgccagcuccauggucaacggcguggucaagcugcucacgaagccgugggacgugauccccauggugacccagaucgccaugaccgacaccacgcccuucgggcagcagcgcgucuucaaggagaagguggacacccggacccccaaggccaagcgcggcaccgcccagaucauggaggugacggcgaaguggcuguggggguuccugagccggaacaagaagccgcgcaucugcacccgggaggaguucacccgcaagguccgguccaacgccgccaucggcgccguguucguggacgagaaccaguggaacagcgcgaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggggcgcgguuccuggaguucgaggcccugggcuucaugaacgaggaccacugguucagccgcgagaacucccucagcggcgucgagggggagggccugcacaagcugggguacauccuccgggacaucuccaagauccccggcgggaacauguacgccgacgacacggccggcugggacacccgcaucaccgaggacgaccugcagaacgaggccaagaucaccgacaucauggagcccgagcacgcgcugcucgccaagagcaucuucaagcugacguaccagaacaagguggugcggguccagcgcccggccaagaacggcaccgugauggacgugaucucccgccgggaccagcgcgggagcggccaggucgggaccuacggccugaacaccuucacgaacauggaggcccagcucauccggcagauggaguccgagggcaucuucagccccuccgagcuggacacccccaaccuggccgggcgcgugcucgacuggcuggagaagcacggcguggagcggcugaagcgcauggcgaucagcggggacgacugcgucgugaagcccaucgacgaccgguucgccaccgcccucaccgcccugaacgacaugggcaaggugcgcaaggacaucccgcagugggagcccagcaagggguggaacgacuggcagcagguccccuucugcucccaccacuuccaccagcugaucaugaaggacggccgggagaucguggugcccugccgcaaccaggacgagcucgucggccgggcccgcgugagccagggggcgggcuggucccugcgggagacggccugccugggcaagagcuacgcccagauguggcagcucauguacuuccaccgccgggaccugcgccuggccgcgaacgccaucugcuccgccgugccggucgacugggugcccaccagccggaccaccugguccauccacgcccaccaccaguggaugacgaccgaggacaugcucagcguguggaaccgcgucuggaucgaggagaaccccuggauggaggacaagacccacaucuccagcuggggcgacgugcccuaccuggggaagcgggaggaccaguggugcggcucccugaucggccucaccgcccgcgcgacgugggccaccaacauccagguggccaucaaccagguccgccggcugcuggggaacgagaacuaccucgacuacaugaccagcaugaagcgcuucaagaacgaguccggcccggagggggcccugugguga

SEQ ID NO: 8744 - RNA, 9879 nt, Artificial Sequence
  derived and/or modified CDS sequence (opt1) from DENV-1__EU482811__SS-prME
agcgugaccaugcugcugaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgggagaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggugcaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacccucugguccaacggcgugcuggagagcgagaugaucauccccaagauccacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugaaguccauggucagcgccggcuccggcgagguggacagcuucucccuggggcugcucugcaucagcaucaugaucgaggaggugaugcggucccgcuggagccggaagaugcugaugaccggcacccuggccgucuucuuccuccugaucauggggcagcugaccuggaacgaccucauccgccugugcaucauggugggcgccaacgcguccgaccgcauggggaugggcacgaccuaccuggcccucauggccaccuucaagaugcggccgauguucgccgugggccugcuguuccgccggcucaccagccgcgagguccugcugcucacgaucgggcugucccugguggccagcgucgagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucggcucccuggggugcaagccgcugaccauguuccucaucgcggagaacaagaucuggggccgcaagagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggacgaugaagaucaaggacgaggagcgcgacgacacccucaccauccugcugaaggcgacccuccuggccgugagcggcgucuacccgcuguccauccccgccacccucuucguguggcacuucuggcagaagaagaagcagcggagcggggugcugugggacacgcccagcccgcccgaggucgagcgcgccgugcuggacgacggcaucuaccggaucaugcagcgcggccugcucgggcggagccaggugggcgucgggguguuccaggagaacguguuccacaccauguggcacgucacccgcggcgccgugcugauguaccaggggaagcggcuggagcccuccugggcgagcgugaagaaggaccucaucuccuacggcggcggguggcgccugcagggcagcuggaacaccggggaggagguccaggugaucgccguggagcccggcaagaaccccaagaacguccagacggcccccgggaccuucaagacccccgagggcgaggugggcgccaucgcccuggacuucaagcccgggaccuccggcagccccaucgugaaccgggaggggaagaucgucggccucuacggcaacgggguggugacgaccagcggcaccuacgucuccgcgaucgcccaggccaaggccagccaggaggggccgcugcccgagaucgaggacgagguguuccgcaagcggaaccugaccaucauggaccuccaccccggcuccgggaagacgcgccgguaccugccggcgaucgugcgcgaggccaucaagcggaagcugcgcacccucauccuggcccccacccgcgucguggccagcgagauggccgaggcgcugaagggcaugcccauccgguaccagaccacggccgugaaguccgagcacaccggcaaggagaucgucgaccucaugugccacgccaccuucaccaugcgccugcugagccccgugcgggugccgaacuacaacaugaucaucauggacgaggcccacuucacggaccccuccagcaucgccgcgcgcggguacaucuccacccgggucggcaugggggaggccgccgccaucuucaugaccgccacgccgcccggcagcauggaggcguucccgcaguccaacgccgugauccaggacgaggagcgcgacauccccgagcggagcuggaacuccggguacgaguggaucacggacuuccccggcaagaccgugugguucguccccagcaucaaggccggcaacgacaucgccaacugccuccgcaagaacgggaagcgggugauccagcugucccgcaagaccuucgacaccgaguaccagaagacgaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugaccgucgccuccgccgcgcagcgccgggggcgcaucggccggaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggacguacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacccugaugcuccuggcccugaucgccgugcucacgggcggggucacccuguucuuccuguccggcaaggggcucggcaagaccagcaucggccugcugugcgugauggccuccagcgugcuccuguggauggcguccgucgagccccacuggaucgccgccagcaucauccuggaguucuuccucauggugcugcugauccccgagccggaccgccagcggacgccccaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucaccccgaugaugcgccacaccaucgagaacaccacggccaacaucagccugaccgccaucgcgaaccaggccgccauccugauggggcucgacaagggcuggcccaucuccaagauggacaucggcgucccccugcuggcccucgggugcuacagccaggugaacccccugacccugaccgcggccgugcucaugcuggucgcccacuacgccaucaucggcccggggcugcaggccaaggcgacgcgggaggcccagaagcgcaccgccgccggcaucaugaagaaccccaccaucgacgggaucguggccaucgaccucgaccccguggucuacgacgcgaaguucgagaagcagcugggccagaucaugcugcucauccugugcaccucccagauccugcucaugcgcacgaccugggcccugugcgagagcaucacccuggccaccggcccccucacgacccugugggagggguccccgggcaaguucuggaacaccaccaucgccgugagcauggccaacaucuuccggggguccuaccuggcgggcgccggccucgccuucagccugaugaagucccucgggggcgggcgccgggggacgggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagaccacgaagcacgccgucucccgcggcaccgccaagcugcggugguucguggagcgcaaccuggugaagcccgaggggaaggucaucgaccugggcugcggccgcgggggcuggagcuacuacugcgccgggcucaagaaggugaccgaggugaagggcuacaccaagggcggccccggccacgaggagcccaucccgauggccacguacggguggaaccuggucaagcugcacuccggcaaggacguguucuucaucccgcccgagaagugcgacacccuccugugcgacaucggggagagcucccccaacccgaccaucgaggagggccgcacccugcgggugcucaagauggucgagcccuggcugcgcgggaaccaguucugcaucaagauccugaaccccuacaugcccagcgugguggagacgcucgagcagaugcagcggaagcacggcggcaugcugguccgcaacccgcugucccggaacagcacccacgagauguacuggguguccugcgggaccggcaacaucgugagcgcggucaacaugaccucccgcaugcuccugaaccgguucaccauggcccaccgcaagcccacguacgagcgcgacguggaccugggggccggcacccggcacguggccgucgagcccgagguggccaaccucgacaucaucggccagcgcaucgagaacaucaagcacgagcacaagagcaccuggcacuacgacgaggacaaccccuacaagaccugggcguaccacggguccuacgaggugaagccgagcggcuccgccagcagcauggucaacgggguggucaagcugcugacgaagcccugggacgugauccccauggugacccagaucgccaugaccgacaccacgcccuucggccagcagcgggucuucaaggagaagguggacacccgcaccccgaaggccaagcgggggaccgcccagaucauggaggugacggcgcgcuggcucuggggcuuccugucccggaacaagaagccccgcaucugcacccgggaggaguucacccgcaagguccggagcaacgccgccaucggcgccguguucguggacgagaaccaguggaacuccgcgaaggaggccgucgaggacgaccgcuucugggaccuggugcaccgggagcgcgagcuccacaagcaggggaagugcgcgaccugcguguacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccggggucgagggcgaggggcuccacaagcugggcuacauccugcgggacaucagcaagauccccgggggcaacauguacgccgacgacacggccggcugggacacccgcaucaccgaggacgaccuccagaacgaggccaagaucaccgacaucauggagccggagcacgcgcugcuggccaaguccaucuucaagcucacguaccagaacaagguggugcggguccagcgccccgccaagaacgggaccgugauggacgugaucagccgccgggaccagcgcggcuccgggcaggucggcaccuacggccugaacaccuucacgaacauggaggcccagcugauccggcagauggagagcgaggggaucuuccuccccaacgagcuggagacccccaaccuggccggccgcgugcucgacuggcuggagaaguacgggguggagcggcugaagcgcauggcgaucuccggcgacgacugcgucgugaagccgaucgacgaccgguucgccaccgcccucaccgcccugaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcucgucgggcgggcccgcgugagccagggcgcgggguggucccugcgggagacggccugccugggcaagagcuacgcccagauguggcagcucauguacuuccaccgccgggaccugcgccuggccgcgaacgccaucugcagcgccgugcccgucgacugggugcccaccucccggaccaccuggagcauccacgcccaccaccaguggaugacgaccgaggacaugcucuccguguggaaccgcgucuggaucgaggagaaccccuggauggaggacaagacccggaucagcuccugggaggacgugccguaccuggggaagcgcgaggaccaguggugcggcagccugaucggccucaccgcccgcgcgacgugggccaccaacauccagguggccaucaaccagguccggcgccugaucgggaacgagaacuacuccgacuacaugaccagcaugaagcgguucaagaacgaguccgagcccgagggcgcccugugguga

SEQ ID NO: 8745 - RNA, 9879 nt, Artificial Sequence
  derived and/or modified CDS sequence (opt1) from DENV-1__EU482812__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggccacccagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucacggucguggugggggacgucgcgggcauccucgcccaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgcguggaacaucugggagguggaggacuacggcuucgggaucuucacgaccaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgcgaacgccagcgaccgcauggggaugggcaccaccuaccuggcccugauggccacguucaagaugcggccgauguucgccgucggccuccuguuccgccggcugaccucccgcgaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcuccccgugcugcugggcagccucgggugcaagccgcugaccauguuccugaucgccgagaacaagaucuggggccggcgcuccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgggacgacacccugaccauccuccugaaggccacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgcggugcucauguaccaggggaagcgccuggagcccagcugggccuccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgcgaggggaagaucgugggccuguacggcaacgggguggucaccaccagcggcacguacgugagcgccaucgcccaggccaaggcgucccaggaggggccgcuccccgagaucgaggacgagguguuccggaagcgcaaccugaccaucauggaccugcaccccggcagcgggaagacccggcgcuaccucccggccaucguccgggaggccaucaagcgcaagcugcgcacccugauccucgcccccacgcgggugguggccuccgagauggcggaggcccugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugacggcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgcgaacuuccgcgccgaccgggucaucgacccgcgccggugccugaagcccgugauccugaaggacgggcccgagcgcgugauccucgccggccccaugccggucaccguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgccauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucgggcuccuguucaugauccugaccgucgccgcgaacgagaugggccuccuggagaccaccaagaaggaccuggggaucggccacguggccguggagaaccaccaccacgccgccaugcucgacgucgaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggucaacccccucacgcugaccgcggccgugcugaugcucguggcccacuacgccaucaucggcccggggcugcaggccaaggcgacccgcgaggcccagaagcggaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggcgaaggagggccugaagcgcggggagaccaccaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgcggucaacaugacgucccgcaugcugcucaaccgcuucaccauggcccaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggcguaccacggguccuacgaggugaagccgagcggcuccgccagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgcgaaguggcuguggggcuuccucucccgcaacaagaagccccggaucugcacccgcgaggaguucacgcggaagguccgcagcaacgccgccaucggcgccguguucguggacgagaaccaguggaacuccgcgaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcgcuccuggccaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcuggagaaguacggcguggagcggcucaagcgcauggcgaucuccggggacgacugcgucgugaagccgaucgacgaccgguucgccacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggcgggcuggagccugcgggagaccgccugccucgggaaguccuacgcccagauguggcagcugauguacuuccaccgccgggaccugcgccucgccgcgaacgccaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggcgaccugggccaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8746 - RNA, 9879 nt, Artificial Sequence
  derived and/or modified CDS sequence (opt1) from DENV-1__EU482813__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgaggaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacacgaaguucgagaagcagcugggccagaucaugcuccugauccugugcaccucccagauccuccugaugcgcaccaccugggcgcugugcgagagcaucacgcucgccaccggcccccugaccacccugugggaggggucccccggcaaguucuggaacacgaccaucgccgugagcauggccaacaucuuccgggggagcuaccucgccggcgcgggccuggccuucucccugaugaagucccucgggggcgggcgccggggcaccggggcccagggcgagacccugggcgagaaguggaagcgccagcugaaccagcucuccaagagcgaguucaacacguacaagcgguccgggaucauggaggucgaccgcagcgaggccaaggagggccugaagcgcggggagaccaccaagcacgcggugucccgcggcaccgccaagcugcggugguucguggagcgcaaccucgucaagccggaggggaaggugaucgaccugggcugcggccgcggcggguggagcuacuacugcgccgggcugaagaaggugacggaggucaagggguacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgccgugaacaugacgucccgcaugcugcugaaccgguucaccauggcgcaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggccuaccacggguccuacgaggucaagcccagcggcagcgcguccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgccaaguggcuguggggcuuccugucccgcaacaagaagccgcggaucugcacccgcgaggaguucacgcggaaggugcgcagcaacgcggccaucggcgccguguucgucgacgagaaccaguggaacuccgccaaggaggcgguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcccugcucgcgaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggccaucuccggcgacgacugcguggugaagcccaucgacgaccgcuucgcgacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggccaccugggcgaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8747 - RNA, 9879 nt, Artificial Sequence
  derived and/or modified CDS sequence (opt1) from DENV-1__EU482814__SS-prME
agcgugacgaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggcuucgggcucgagacgcgcaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaccguccaguacgagaaccucaaguacagcgugaucgugaccguccacacgggcgaccagcaccagguggggaacgaguccaccgagcacggcaccaccgcgaccaucacgccccaggcccccagcaccgagauccagcugaccgacuacggggcccugacccucgacugcagcccccggacgggccuggacuucaacgagaugguccugcucaccaugaaggagaaguccuggcuggugcacaagcagugguuccuggaccucccgcugcccuggaccagcggggccuccaccagccaggagacguggaaccggaaggaccugcucgugaccuucaagaccgcccacgcgaagaagcaggaggucguggugcugggcucccaggagggcgccaugcacaccgcccugacgggggccaccgagauccagaccagcggcaccacgaccaucuucgccgggcaccucaagugccgccugaagauggacaagcugacccucaagggcauguccuacgucaugugcaccgggagcuucaagcuggagaaggagguggcggagacgcagcacggcaccgugcugguccagaucaaguacgagggcaccgacgcccccugcaagauccccuucuccacccaggacgagaagggggugacgcagaacggccggcucaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccugggcgacacggccugggacuucgggagcaucggcggcguguucaccuccgucgggaagcucgugcaccagaucuucggcaccgccuacggggugcuguucagcggcgucuccuggaccaugaagaucgggaucggcgugcugcucacguggcugggccugaacagccgcuccaccagccucuccaugaccugcaucgccguggggcuggucacccuguaccucggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacgguggucguggacgagcacugcggcaaccgggggccgagccuccgcaccaccaccgugacgggcaagaucauccacgaguggugcugccgguccugcacccugccgccccugcgcuucaagggggaggacggcugcugguacgggauggagauccggcccgucaaggagaaggaggagaaccucgucaagagcauggugagcgccggcuccggcgaggucgacagcuucucccuggggcugcucugcaucagcaucaugaucgaggaggugaugcgcucccgguggagccgcaagaugcugaugaccggcacccuggccguguucuuccuccugaucauggggcagcugacguggaacgaccucauccggcugugcaucauggucggcgcgaacgccuccgaccgcauggggaugggcaccaccuaccuggcccucauggccaccuucaagaugcgcccgauguucgccgugggccugcuguuccggcgccucacgagccgggaggugcugcugcucaccaucgggcugucccuggucgcgagcguggagcuccccaacucccuggaggagcugggcgacgggcucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccgugcugcucggcucccuggggugcaagccgcugacgauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggaccaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacccccagcccgcccgagguggagcgggccguccuggacgacggcaucuaccgcaucaugcagcggggccuccuggggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcuggacuucaagcccgggacgagcggcagccccaucgugaaccgcgaggggaagaucgugggccucuacggcaacggggucgugaccaccuccggcaccuacgugagcgccaucgcccaggccaaggcgucccaggaggggccccugccggagaucgaggacgaggucuuccggaagcgcaaccugacgaucauggaccuccaccccggcagcgggaagacccggcgcuaccugcccgccaucgugcgggaggccaucaagcgcaagcugcggacccucauccuggccccgacccgcguggucgccuccgagauggcggaggcccugaagggcaugcccauccgcuaccagacgaccgccgucaagagcgagcacaccggcaaggagaucguggaccucaugugccacgccaccuucacgaugcggcugcugucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccugaagccggugauccucaaggacgggcccgagcgcgucauccuggccggccccaugcccgugacggucgccuccgccgcgcagcggcgcgggcggaucggccgcaaccacaacaaggagggcgaccaguacaucuacauggggcagccgcugaacaacgacgaggaccacgcccacuggaccgaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgcggccggccgccggagcgucuccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucacccccaugaugcgccacaccaucgagaacacgaccgccaacaucagccugaccgccaucgcgaaccaggccgccauccugauggggcucgacaagggcuggccgaucuccaagauggacaucggcgucccccugcuggcccucgggugcuacagccaggugaacccccugacccugacggcggccgugcucaugcuggucgcccacuacgccaucaucggccccgggcugcaggccaaggcgacccgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgccgugagcauggccaacaucuuccgggggagcuaccuggcgggcgccggccucgccuucucccugaugaagucccucgggggcgggcgccgggggaccggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagccggaggggaaggugaucgaccucggcugcggccgcggcggguggagcuacuacugcgccgggcugaagaaggugaccgaggucaagggguacacgaagggcgggcccggccacgaggagcccauccccauggccaccuacggguggaaccuggugaagcugcacuccggcaaggacguguucuucaucccgcccgagaagugcgacacccuccugugcgacaucggggagagcucccccaaccccaccaucgaggagggccgcacgcugcggguccucaagaugguggagccguggcugcgcgggaaccaguucugcaucaagauccugaaccccuacaugcccagcguggucgagacccucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgguucacgauggcccaccgcaagccgaccuacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagcccgagcacgcgcugcuggccaaguccaucuucaagcucaccuaccagaacaaggugguccgcgugcagcggccggccaagaacgggaccgugauggacgucaucagccgccgcgaccagcggggcuccggccaggugggcaccuacggccugaacacguucaccaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugacggcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagaccgccugccugggcaaguccuacgcccagauguggcagcugauguacuuccaccggcgcgaccuccggcuggccgcgaacgccaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugacggcccgggcgaccugggccaccaacauccaggucgccaucaaccaggugcgccgccucaucggcaacgagaacuaccuggacuacaugaccuccaugaagcgguucaagaacgagagcgacccggagggggcccugugguga

SEQ ID NO: 8748 - RNA, 9879 nt, Artificial Sequence
  derived and/or modified CDS sequence (opt1) from DENV-1__EU482815__SS-prME
agcgugaccaugcugcucaugcugaugcccgccgcccuggcguuccaccucaccacgcggggcggggagccccacaugaucgugagcaagcaggagcggggcaagagccugcuguucaagaccagcgccggggugaacaugugcacccucaucgccauggaccugggcgaguucugcgaggacaccaugacguacaagugcccccgcaucaccgaggccgagcccgacgacguggacugcuggugcaacgccaccgacaccugggugacguacgggaccugcagccagaccggcgagcaccggcgggacaagcgguccguggcgcuggcgccccacgugggccucgggcuggagacccgcacggagaccuggaugagcuccgagggcgccuggaagcagauccagcgggucgagaccugggcccugcgccaccccggguucaccgugaucgcccuguuccuggcccacgccaucggcacgagcaucacccagaaggggaucaucuucauccugcucaugcuggugacccccuccauggccaugcggugcgucggcaucggcagccgcgacuucguggaggggcuguccggcgccaccuggguggacgucgugcucgagcacgggagcugcgugacgaccauggcgaaggacaagcccacccuggacaucgagcugcucaagaccgaggucacgaaccccgccgugcugcggaagcugugcaucgaggccaagaucuccaacaccaccaccgacagccgcugcccgacgcagggcgaggccacccucguggaggagcaggacgccaacuucgucugccggcgcaccuucguggaccggggcugggggaacggcugcgggcuguucggcaaggggucccugaucacgugcgcgaaguucaagugcgugacgaagcucgagggcaagaccguccaguacgagaaccugaaguacagcgugaccgugaccguccacacgggcgaccagcaccagguggggaacgaguccaccgagcacggcaccaccgccaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcgcacgccaagaagcaggaggucguggugcugggcucccaggagggcgccaugcacaccgcccucacgggggccaccgagauccagaccagcggcaccacgaccaucuucgcggggcaccugaagugccgccugaagauggacaagcucacccugaagggcauguccuacgucaugugcaccgggagcuucaagcuggagaaggagguggccgagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggcggagccgcccuucggggagagcuacaucgugaucggcgccggcgagaaggcccugaagcuguccugguucaagaaggggagcuccaucggcaagauguucgaggccaccgcccgcggggcgcggcgcauggccauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggcggacagcgggugcgucaucaacuggaagggccgggagcugaagugcgggagcggcaucuucgugacgaacgaggugcacaccuggaccgagcaguacaaguuccaggccgacuccccgaagcgccucagcgccgccaucggcaaggccugggaggagggggucugcggcauccgguccgcgacccgccuggagaacaucauguggaagcagaucagcaacgagcugaaccacauccuccuggagaacgacaugaaguucaccgugguggucggggacguggccggcauccuggcccaggggaagaagaugauccggccccagcccauggaguacaaguacuccuggaaguccuggggcaaggccaagaucaucggcgcggacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgcggacaugggcuacuggaucgagagcgagaagaacgagaccuggaagcucgcccgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgcgguguucuuccugcugaucauggggcagcucacguggaacgaccugauccggcugugcaucauggucggcgccaacgccuccgaccgcauggggaugggcaccaccuaccucgcccugauggccaccuucaagaugcgcccgauguucgcggugggccuccucuuccggcgccugacgagccgggaggugcugcuccugaccaucgggcugucccucgucgccagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgcguggaagaccauggccaugguccuguccaucgugagccuguucccccucugccuguccacgaccagccagaagaccaccuggcugcccgugcuccugggcucccuggggugcaagccgcucacgauguucuucaucgccgagaacaagaucuggggccgcaagagcuggccccugaacgaggggaucauggccgucggcaucgugagcauccugcucuccagccugcugaagaacgacgugccccucgccgggccccugaucgcgggcggcaugcugaucgccugcuacgucaucuccgggagcuccgccgaccucagccuggagaaggccgccgagguguccugggaggaggaggcggagcacagcggcgccucccacaacauccugguggagguccaggacgacgggaccaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacccccagcccgcccgagguggagcgggcgguccuggacgacggcaucuaccgcaucaugcagcggggccuccuggggcgcagccaggugggcgugggggucuuccaggagaacguguuccacaccauguggcacgugacccggggcgccguccugauguaccaggggaagcgccuggagcccuccugggccagcgugaagaaggaccucaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgcgaucgcccuggacuucaagcccgggacgagcggcagccccaucgugaaccgcgaggggaagaucgugggccucuacggcaacggggucgugaccaccuccggcaccuacgugagcgccaucgcccaggcgaaggccucccaggaggggccccugccggagaucgaggacgaggucuuccggaagcgcaaccugacgaucauggaccuccaccccggcagcgggaagacccggcgcuaccugcccgccaucgugcgggaggccaucaagcgcaagcugcggacccucauccuggccccgacccgcguggucgcguccgagauggccgaggcccugaagggcaugcccauccgcuaccagacgaccgccgucaagagcgagcacaccggcaaggagaucguggaccucaugugccacgccaccuucacgaugcggcugcugucccccguccgcgugcccaacuacaacaugaucaucauggacgaggcgcacuucaccgacccgagcuccaucgccgcccggggguacaucagcacccgcgugggcaugggggaggccgccgcgaucuucaugaccgccacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgcgaacugccuccggaagaacgggaagcgcgugauccagcugucccggaagaccuucgacacggaguaccagaagaccaagaacaacgacugggacuacguggucaccaccgacaucagcgagaugggcgccaacuuccgcgccgaccgggugaucgacccccgccggugccugaagccggugauccucaaggacgggcccgagcgcgucauccuggccggccccaugcccgugacggucgccuccgcggcccagcggcgcgggcggaucggccgcaaccacaacaaggagggcgaccaguacaucuacauggggcagccgcugaacaacgacgaggaccacgcccacuggaccgaggccaagaugcuccuggacaacaucaacacccccgagggcaucauccccgcccuguucgagcccgagcgggagaaguccgcggccaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcgcugcgggaguucaaggaguucgccgccggccgccggagcgucuccggggaccucauccuggagaucggcaagcugccccagcaccucacccagcgcgcccagaacgcgcuggacaaccuggugaugcuccacaacagcgagcagggcgggcgggccuaccgccacgccauggaggagcugccggacaccaucgagacgcugaugcuccuggcccugaucgccgugcucaccggcggggucacccuguucuuccuguccggccgggggcucggcaagaccagcaucggccugcugugcgugauggcguccagcgcccuccuguggauggccuccguggagccccacuggaucgccgccagcaucauccuggaguucuuccucaugguccugcugauccccgagcccgaccgccagcggaccccgcaggacaaccagcucgcguacguggugaucgggcugcuguucaugauccucacggucgccgccaacgagaugggccugcuggagaccaccaagaaggaccucgggaucggccacguggccguggagaaccaccaccacgccgcgaugcuggacgucgaccugcaccccgccuccgccuggacccucuacgccguggccacgaccaucaucacccccaugaugcgccacaccaucgagaacacgaccgcgaacaucagccugaccgccaucgccaaccaggccgcgauccugauggggcucgacaagggcuggccgaucuccaagauggacaucggcgugccccugcuggcccucgggugcuacagccaggucaacccccugacccugacggccgccgugcucaugcugguggcccacuacgcgaucaucggccccgggcugcaggccaaggccacccgggaggcccagaagcgcaccgccgcgggcaucaugaagaacccgaccgucgacgggaucguggccaucgaccucgaccccguggucuacgacgccaaguucgagaagcagcugggccagaucaugcugcucauccugugcacgucccagauccugcucaugcgcaccaccugggcccugugcgagagcaucacccuggccacgggcccccucaccacccugugggaggggucccccggcaaguucuggaacaccacgaucgcggugagcauggccaacaucuuccgggggagcuaccuggccggcgccggccucgcguucucccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggccaaggagggccucaagcgcggggagacgaccaagcacgccgucucccgcggcaccgccaagcugcggugguucguggagcgcaaccuggugaagccggaggggaaggucaucgaccucggcugcggccgcggcggguggagcuacuacugcgcggggcugaagaaggugaccgaggugaagggguacacgaagggcggccccggccacgaggagcccauccccauggccaccuacggguggaaccuggucaagcugcacuccggcaaggacguguucuucaucccgcccgagaagugcgacacccuccugugcgacaucggggagagcucccccaaccccaccaucgaggagggccgcacgcugcgggugcucaagauggucgagccguggcugcgcgggaaccaguucugcaucaagauccugaaccccuacaugcccagcgugguggagacccucgagcagaugcagcggaagcacggcggcaugcugguccgcaacccccugucccggaacagcacccacgagauguacuggguguccugcgggaccggcaacaucgugagcgccgucaacaugaccucccgcaugcuccugaaccgguucacgauggcccaccgcaagccgaccuacgagcgcgacguggaccugggggccggcacccggcacguggcggucgagcccgagguggccaaccucgacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcugaccaagccgugggacgugauccccauggugacccagaucgccaugaccgacacgacccccuucggccagcagcgggucuucaaggagaagguggacacccgcacccccaaggcgaagcgggggacggcccagaucauggaggugaccgccaaguggcucuggggcuuccugucccgcaacaagaagccgcggaucugcacccgcgaggaguucacccggaagguccgcagcaacgccgcgaucggcgccguguucguggacgagaaccaguggaacuccgccaaggaggccgucgaggacgagcgguucugggaccuggugcaccgcgagcgggagcuccacaagcaggggaagugcgccacgugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgcgggcugggacacccggaucaccgaggacgaccuccagaacgaggccaagaucacggacaucauggagcccgagcacgcccugcuggccaaguccaucuucaagcucaccuaccagaacaagguggugcgcguccagcggccggccaagaacgggaccgugauggacgugaucagccgccgcgaccagcggggcuccgggcaggucggcaccuacggccugaacacguucaccaacauggaggcgcagcugauccgccagauggagagcgaggggaucuucucccccagcgagcucgagacccccaaccuggccggccgggugcuggacuggcucgagaagcacgggguggagcgccugaagcggauggccaucuccggcgacgacugcgucgugaagcccaucgacgaccgcuucgccaccgcccugacggcgcucaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcuggucgggcgcgcccgggugucccagggcgccggguggagccuccgcgagaccgccugccugggcaaguccuacgcgcagauguggcagcugauguacuuccaccggcgcgaccuccggcuggccgccaacgccaucugcagcgccgugccggucgacugggugcccaccucccgcaccacguggagcauccacgcgcaccaccaguggaugaccaccgaggacaugcuguccguguggaaccgggucuggaucgaggagaaccccuggauggaggacaagacccacaucagcuccuggggcgacgugcccuaccucggcaagcgcgaggaccaguggugcggcagccugaucgggcugacggcccgggccaccugggccaccaacauccagguggccaucaaccagguccgccgccucaucggcaacgagaacuaccuggacuacaugaccuccaugaagcgguucaagaacgagagcgacccggagggggcgcugugguga

SEQ ID NO: 8749 - RNA, 9879 nt, Artificial Sequence
  derived and/or modified CDS sequence (opt1) from DENV-1__EU482816__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgugauggugcaggccgacagcgggugcgucaucaacuggaagggccgggagcugaagugcgggagcggcaucuucgugacgaacgaggugcacaccuggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgcgaacgccuccgaccgcauggggaugggcaccaccuaccucgcccugauggccaccuucaagaugcgcccgauguucgccguggggcuccuguuccggcgccugacgagccgggaggugcugcuccugaccaucgggcugucccucgucgcgagcguggagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgccuggaagaccauggcgaugguccuguccaucgugagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcgcucgacuucaagcccgggacgagcggcagccccaucgugaaccgcgaggggaagaucgugggccuguacggcaacggggucgugaccaccuccggcaccuacgugagcgccaucgcccaggccaaggcgucccaggaggggccccugccggagaucgaggacgaggucuuccggaagcgcaaccucacgaucauggaccugcaccccggcagcgggaagacccggcgcuaccugcccgccaucgugcgggaggccaucaagcgcaagcuccggacccugauccuggccccgacccgcguggucgccuccgagauggcggaggcccucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugacggucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgucccccugcucgcccuggggugcuacagccaggugaacccccugacccucacggcggccgugcugaugcuggucgcccacuacgccaucaucggccccgggcuccaggccaaggcgacccgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacacgaagggcgggcccggccacgaggagcccauccccauggccaccuacggguggaaccuggugaagcuccacuccggcaaggacguguucuucaccccgcccgagaagugcgacacccugcugugcgacaucggggagagcucccccaaccccacgaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugacgucccgcaugcugcugaaccgguucaccauggcccaccgcaagccgaccuacgagcgcgacguggaccucggggccggcacccggcacgucgccguggagcccgagguggccaaccuggacaucaucggccagcgcaucgagaacaucaagcacgagcacaagagcacguggcacuacgacgaggacaaccccuacaagaccugggcguaccacggguccuacgaggucaagcccagcggcagcgccuccagcauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccugucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggugguccgcgugcagcggccggccaagaacgggaccgugauggacgucaucagccgccgcgaccagcggggcuccggccaggugggcacguacggccugaacaccuucaccaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccacggcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagaccgccugccugggcaaguccuacgcccagauguggcagcucauguacuuccaccggcgcgaccugcggcuggccgcgaacgccaucugcagcgccgucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggcgaccugggccaccaacauccaggucgccaucaaccaggugcgccgccugaucggcaacgagaacuaccuggacuacaugaccuccaugaagcgguucaagaacgagagcgacccggagggggcccucugguga

SEQ ID NO: 8750 - RNA, 9879 nt, Artificial Sequence
  derived and/or modified CDS sequence (opt1) from DENV-1__EU482821__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcaaccgcgacuucguggaggggcucagcggcgccaccuggguggacgucgugcuggagcacggguccugcgugaccaccauggccaaggacaagcccacgcuggacaucgagcuccugaagaccgaggucaccaaccccgccgugcugcggaagcucugcaucgaggcgaagaucagcaacaccacgaccgacucccgcugcccgacccagggcgaggccacccugguggaggagcaggacgccaacuucgucugccggcgcacguucguggaccggggcugggggaacggcugcgggcuguucggcaaggggagccucaucacgugcgccaaguucaagugcgugaccaagcuggagggcaagaucguccaguacgagaaccugaaguacuccgugaucgugaccguccacacgggcgaccagcaccagguggggaacgagagcaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccuccggggccagcacgagccaggagaccuggaaccggcaggaccugcuggugaccuucaagaccgcccacgccaagaagcaggaggucguggugcucggcucccaggagggcgcgaugcacacggcccugaccggggccaccgagauccagaccagcggcacgaccaccaucuucgccgggcaccugaagugccgccucaagauggacaagcugacccugaagggcauguccuacgucaugugcacggggagcuucaagcucgagaaggagguggccgagacccagcacggcaccgugcugguccagaucaaguacgagggcaccgacgcgcccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccgucgggaagcuggugcaccagaucuucggcaccgccuacgggguccucuucagcggcgucuccuggacgaugaagaucgggaucggcgugcugcugaccuggcucggccugaacagccgcuccaccagccuguccaugaccugcaucgccguggggcucgucacgcuguaccugggcgugauggugcaggccgacagcgggugcgucaucaacuggaagggccgggagcucaagugcggguccggcaucuucgugaccaacgaggugcacaccuggaccgagcaguacaaguuccaggccgacagcccgaagcgccugagcgcggccaucggcaaggccugggaggagggggucugcggcauccgguccgccacccgccuggagaacaucauguggaagcagaucagcaacgagcucaaccacauccugcuggagaacgacaugaaguucacggugguggucggggacguggccggcauccucgcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagacgugcaucuggcccaagagccacacccugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcacgaccguggucguggacgagcacugcggcaaccgggggccgagccugcgcaccaccacggugaccggcaagaucauccacgaguggugcugccgguccugcacccugccgccccuccgcuuccgcggggaggacggcugcugguacgggauggagauccgccccgucaaggagaaggaggagaaccuggucaagagcaugguguccgccggcagcggcgaggucgacagcuucucccucgggcugcugugcaucagcaucaugaucgaggaggugaugcggucccgcuggagccggaagaugcucaugaccggcacgcuggccguguucuuccugcucaucauggggcagcugaccuggaacgaccugauccgccucugcaucauggucggcgccaacgcguccgaccgcauggggaugggcaccaccuaccuggcccugauggccacguucaagaugcggccgauguucgccguggggcuccuguuccgccggcugaccagccgcgaggugcuccugcugaccaucgggcucucccuggucgccagcguggagcugcccaacucccucgaggagcugggcgacgggcuggcgaugggcaucaugauccucaagcugcugaccgacuuccagagccaccagcucugggccacgcugcugucccucaccuucaucaagaccaccuucagccugcacuacgccuggaagacgauggccaugguccuguccaucgugagccucuucccccugugccuguccaccaccagccagaagaccacguggcuccccgugcugcugggcucccucgggugcaagccgcugaccauguuccugaucgcggagaacaagaucuggggccggcgcagcuggccccucaacgaggggaucauggccgucggcaucguguccauccugcugagcagccuccugaagaacgacgugccccuggccgggccccucaucgccggcggcaugcugaucgccugcuacgucaucuccgggagcuccgcggaccugagccucgagaaggccgccgagguguccugggaggaggaggccgagcacagcggcgccucccacaacauccugguggagguccaggacgacgggaccaugaagaucaaggacgaggagcgggacgacacccugaccauccuccugaaggcgacgcugcucgccgugagcggcguguacccgcuguccauccccgccacccuguucgucugguacuucuggcagaagaagaagcagcgcagcggggugcucugggacacccccagcccgcccgaggugggccgggccguccuggacgacggcaucuaccgcaucaugcagcgggggcugcugggccgcagccaggugggggugggcgucuuccaggagaacguguuccacaccauguggcacgugacgcgcggggccguccucauguaccagggcaagcgccuggagcccuccugggcgagcgugaagaaggaccugaucuccuacggcgggggcuggcggcuccaggggagcuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccuccgggagccccaucgugaaccgcgagggcaagaucgugggccuguacgggaacggcgucgugaccaccuccgggacguacgugagcgcgaucgcccaggccaaggccagccaggagggcccgcuccccgagaucgaggacgaggucuuccggaagcgcaaccugaccaucauggaccugcaccccggguccggcaagacccggcgcuaccucccggcgaucgugcgggaggccaucaagcgcaagcugcgcacccugauccucgcccccacgcggguggucgccagcgagauggccgaggcgcugaagggcaugcccauccgcuaccagaccaccgccgugaaguccgagcacaccgggaaggagaucguggaccugaugugccacgccacguucaccaugcggcuccugagccccguccgcgugccgaacuacaacaugaucaucauggacgaggcccacuucaccgaccccuccagcaucgccgcgcggggcuacaucuccacccgcguggggaugggcgaggccgccgccaucuucaugacggccacgccgcccgggagcgucgaggcguucccgcaguccaacgccgugauccaggacgaggagcgggacauccccgagcgcagcuggaacuccggcuacgaguggaucaccgacuuccccggcaagaccgugugguucguccccagcaucaaguccgggaacgacaucgccaacugccugcggaagaacggcaagcgcgugauccagcucagccggaagacguucgacaccgaguaccagaagaccaagaacaacgacugggacuacguggucaccacggacaucuccgagaugggggccaacuuccgcgcggaccgggugaucgacccgcgccggugccugaagcccgugauccugaaggacggccccgagcgcgucauccucgccgggcccaugccggugaccgucgccagcgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccccucgcccugcgggaguucaaggaguucgccgcggggcgccgguccgucagcggcgaccugauccucgagaucggcaagcugccgcagcaccugacccagcgcgcccagaacgcccucgacaaccuggugaugcugcacaacuccgagcagggcgggcgggccuaccgccacgcgauggaggagcuccccgacacgaucgagacccugaugcugcucgcccugaucgccgugcugaccgggggcgucacccucuucuuccugagcgggcggggccugggcaagaccuccaucgggcuccugugcgugauggccagcuccgugcugcucuggauggccagcgucgagccccacuggaucgcggccuccaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccagcgccuggacgcuguacgcgguggccaccaccaucaucaccccgaugaugcgccacacgaucgagaacaccaccgccaacaucucccucaccgccaucgccaaccaggcggccauccugaugggccuggacaagggcuggcccaucagcaagauggacaucggggucccccuccuggcccugggcugcuacucccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccagccagauccugcugaugcgcaccaccugggcgcucugcgaguccaucacgcuggccaccgggccccugaccacccucugggagggcagcccggggaaguucuggaacacgaccaucgccguguccauggccaacaucuuccggggcagcuaccuggccggcgcggggcuggccuucucccucaugaagucccugggcgggggccgccgggggaccggcgcccagggcgagacccugggggagaaguggaagcgccagcucaaccagcugagcaaguccgaguucaacacguacaagcggagcggcaucauggaggucgaccgcuccgaggccaaggaggggcugaagcggggcgagaccaccaagcacgcggugagccgcgggaccgccaagcuccggugguucguggagcgcaaccuggucaagcccgagggcaaggugaucgaccugggcugcgggcggggcgggugguccuacuacugcgccggccugaagaaggugacggaggucaagggguacaccaagggcggccccgggcacgaggagcccaucccgauggccaccuacggcuggaaccucgugaagcugcacagcgggaaggacguguucuucaucccgcccgagaagugcgacacccugcucugcgacaucggcgaguccagccccaacccgacgaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacccacgagauguacugggugagcugcggcaccgggaacaucgucuccgccgugaacaugacgagccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaaguccacguggcacuacgacgaggacaaccccuacaagaccugggccuaccacggcagcuacgaggucaagccguccgggagcgcguccagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucagccgcaacaagaagccccggaucugcacccgcgaggaguucacgcggaaggugcgcuccaacgcggccaucggggccguguucgucgacgagaaccaguggaacagcgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaacauccccggcggcaacauguacgccgacgacaccgccgggugggacacccggaucacggaggacgaccugcagaacgaggcccgcaucaccgacaucauggagccggagcacgcccuccuggccaagagcaucuucaagcugaccuaccagaacaaggugguccgcgugcagcggcccgccaagaacggcaccgugauggacgucaucucccgccgggaccagcgcgggagcggccaggugggcacguacgggcucaacaccuucaccaacauggaggcccagcugauccggcagauggaguccgagggcaucuucagccccuccgagcuggagacccccaaccucgccgagcgcgugcuggacuggcuggagaaguacggggucgagcggcucaagcgcauggccaucagcggcgacgacugcguggugaagccgaucgacgaccgguucgcgacggcccugaccgcccugaacgacauggggaagguccgcaaggacaucccccagugggagcccuccaagggcuggaacgacuggcagcagguccccuucugcagccaccacuuccaccagcucaucaugaaggacggccgggagaucguggucccgugccgcaaccaggacgagcugguggggcgggcccgcgugucccagggcgccggguggagccugcgggagaccgcgugccucggcaagagcuacgcccagauguggcagcugauguacuuccaccgccgggaccugcgccucgccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccugggcaagcgcgaggaccaguggugcggcucccucaucgggcugaccgcccgggccaccugggcgaccaacauccagguggccaucaaccagguccgccggcugaucggcaacgagaacuaccucgacuacaugaccagcaugaagcgcuucaagaacgaguccgaccccgagggggcccugugguga

SEQ ID NO: 8751 - RNA, 9879 nt, Artificial Sequence
  derived and/or modified CDS sequence (opt1) from DENV-1__EU482822__SS-prME
uccgugaccaugcugcucaugcugaugcccaccgcccuggccuuccaccucaccacccggggcggggagccccacaugaucgugaccaagcaggagcggggcaagucccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcgauccugcggaagcucugcaucgaggccaagaucagcaacaccacgaccgacucccgcugccccacccagggcgaggccacccugauggaggagcaggacgccaacuucgugugccggcgcacguucguggaccggggcugggggaacggcugcgggcuguucggcaaggggagccucaucacgugcgccaaguucaagugcgucaccaagcuggagggcaagaucgugcaguacgagaaccugaaguacuccgugaucgucaccgugcacacgggcgaccagcaccagguggggaacgagagcaccgagcacggcaccaccgcgaccaucacgccccaggcccccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggucaccuucaagaccgcccacgcgaagaagcaggagguggugguccucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcgucuucaccagcaucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccuggggcuccugugcaucuccaucaugaucgaggaggugaugcgcagccgguggucccgcaagaugcugaugaccggcacccucgccgucuuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgugggccuccuguuccggcgccugacgucccgggagguccuccugcugaccaucgggcucagccugguggccuccguggagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccaugguccucagcaucgugucccugaucccccugugccucagcacgaccucccagaagaccaccuggcugcccguccugcucggcagccuggggugcaagccgcugacgauguuccucaucgcggagaacaagaucuggggccgcaaguccuggccccugaacgaggggaucauggccgugggcguggucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacuccauccugguggaggugcaggacgacgggaccaugaagaucaaggacgaggagcgggacgacacccucaccauccugcugaaggcgacccuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggcgagcgucaagaaggaccucaucuccuacggcggcggguggcggcugcagggcagcuggaacacgggggaggagguccaggugaucgccgucgagcccggcaagaaccccaagaacgugcagaccgcccccgggaccuucaagacccccgagggcgaggugggcgccaucgcccuggacuucaagcccgggacguccggcagccccaucgucaaccgcgaggggaagaucgugggccucuacggcaacgggguggucaccaccagcggcaccuacguguccgcgaucgcccaggccaaggccagccaggaggggccgcugcccgagaucgaggacgagguguuccggaagcgcaaccugacgaucauggaccuccaccccggcuccgggaagacccggcgcuaccugccggcgaucguccgggaggccaucaagcgcaagcugcggacccucauccuggcccccacccgcgugguggccagcgagauggccgaggcgcugaagggcaugcccauccgcuaccagacgaccgccgucaaguccgagcacaccggcaaggagaucguggaccucaugugccacgccaccuucacgaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugaccgccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagaccuucgacacggaguaccagaagaccaagaacaacgacugggacuacguggugaccaccgacaucuccgagaugggcgccaacuuccgcgcggaccgggucaucgacccgcgccggugccugaagcccgugauccucaaggacgggcccgagcgcgugauccuggccggccccaugccggucacgguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccgcggcgaggcgcggaagaccuucgucgagcugaugcgccgcggggaccugcccguguggcucagcuacaagguggccagcgagggcuuccaguacuccgaccgccgguggugcuucgacggcgagcgcaacaaccagguccuggaggagaacauggacguggagaucuggacgaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacaccaucgagacgcugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucacggucgccgccaacgagaugggccugcuggagaccaccaagaaggaccucgggaucggccacguggcgguggagaaccaccaccacgccaccaugcuggacgucgaccugcaccccgccagcgccuggacgcucuacgccguggcgaccaccaucaucaccccgaugaugcgccacacgaucgagaacaccaccgccaacaucucccugaccgccaucgccaaccaggccgcgauccugauggggcucgacaagggcuggcccaucagcaagauggacaucggcgugccccugcuggcccucgggugcuacucccaggucaacccccugacgcugaccgccgccgugcucaugcugguggcgcacuacgccaucaucggcccggggcugcaggccaaggccacccgggaggcccagaagcgcaccgcggccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcccugugcgaguccaucacgcuggcgaccggcccccucaccacccugugggaggggagcccgggcaaguucuggaacacgaccaucgccguguccauggccaacaucuuccgggggagcuaccuggccggcgccggccucgcguucagccugaugaagucccucgggggcgggcgccgggggaccggggcccagggcgagacccucggcgagaaguggaagcgccagcugaaccagcugagcaaguccgaguucaacaucuacaagcggagcgggaucauggagguggaccgcuccgaggccaaggagggccucaagcgcggggagacgacccgccacgccgucagccggggcaccgcgaagcugcgcugguucguggagcggaaccuggugaagcccgaggggaaggucaucgaccugggcugcggccgcgggggcugguccuacuacugcgccgggcucaagaaggugaccgaggugaagggcuacacgaagggcgggcccggccacgaggagcccaucccgauggccaccuacggguggaaccuggucaagcugcacagcggcaaggacguguucuucacgccgcccgagaagugcgacacccuccugugcgacaucggggaguccagccccaacccgacgaucgaggagggccggacccugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgccgucaacaugacgagccggaugcuccugaaccgcuucaccauggcccaccgcaagcccaccuacgagaaggacguggaccugggggcgggcacccggcacguggccgucgagcccgagguggccaaccucgacaucaucggccagcgcaucgagaacaucaagcacgagcacaaguccacguggcacuacgacgaggacaaccccuacaagaccugggccuaccacgggagcuacgaggugaagccguccggcagcgccagcuccauggucaacgggguggucaagcugcugaccaagcccugggacgugauccccauggugacccagaucgcgaugacggacaccacccccuucggccagcagcgggucuucaaggagaagguggacacccgcacgccgaaggccaagcgggggaccgugcagaucauggaggucaccgcccgcuggcucuggggcuuccugagccggaacaagaagccccgcaucugcacccgggaggaguucacgcgcaaggugcgguccaacgccgccaucggcgcgguguucgucgacgagaaccaguggaacagcgccaaggaggccguggaggacgagcgcuucugggaccuggugaagaaggagcgggagcuccacaagcaggggaagugcgcgaccugcgucuacaacaugaugggcaagcgcgagaagaagcugggggaguucggcaaggcgaaggggucccgggccaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgccgacgacaccgcgggcugggacacccggaucacggaggacgaccuccagaacgaggccaagaucaccgacaucauggagccggagcacgcccugcuggccaccagcaucuucaagcucaccuaccagaacaaggugguccgcgugcagcggcccgccaagaacgggacggugauggacgucaucucccgccgcgaccagcggggcagcggccaggugggcaccuacggccugaacaccuucaccaacauggaggcgcagcugauccgccagauggaguccgaggggaucuuccuccccagcgagcuggagacgcccaaccuggccgagcgggugcucgacuggcuggagaaguacggcgucgagcgccugaagcggauggccaucuccggggacgacugcguggugaagccgaucgacgaccgcuucgccaccgcccucaccgcgcugaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcucgugggccgcgcccgggugagccagggggccggcuggagccugcgcgagaccgccugccuggggaaguccuacgcccagauguggcagcucauguacuuccaccggcgcgaccugcggcuggcggccaacgccaucugcagcgccguccccguggacugggugcccacgucccgcaccaccuggagcauccacgcgcaccaccaguggaugaccacggaggacaugcucuccgucuggaaccggguguggaucgaggagaaccccuggauggaggacaagacccacgugagcuccuggggcgacgucccguaccuggggaagcgcgaggaccaguggugcggcagccugaucggccucaccgcccgggccaccugggccuccaacauccagguggccaucaaccaggugcgccgccugaucgggaacgagaacuaccuggacuacaugaccagcaugaagcgguucaagaacgagggcgaccccgagggggcgcucugguga

SEQ ID NO: 8752 - RNA, 9879 nt, Artificial Sequence
  derived and/or modified CDS sequence (opt1) from DENV-1__EU482476__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgggaugaaguucaccgucguggugggcgacgucguggggauccucgcgcagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgccuggaacaucugggaggucgaggacuacggguucggcaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuucaagggcgaggacgggugcugguacggcauggagauccggcccgucaaggagaaggaggagaaccuggugaaguccauggugagcgccggcagcggggaggucgacuccuucagccucggccugcugugcaccuccaucaugaucgaggaggugaugcgcagccgguggucccgcaagaugcucaugaccgggacgcuggccguguuccugcuccugaucaugggccagcugaccuggaacgaccucauccggcugugcaucauggucggggccaacgcgagcgaccgcaugggcaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggggacggccucgcgaugggcaucaugauccugaagcugcucaccgacuuccagucccaccagcugugggccacgcugcucagccugaccuucaucaagaccacccugucccuccacuacgccuggaagacgauggccaugguccugagcaucgugucccuguucccccucugccugagcaccaccucccagaagaccacguggcugcccgugcuccuggggagccugggcugcaagccgcucaccauguuccugaucgcggagaacaagaucugggggcgcaaguccuggccccugaacgagggcaucauggccgucgggguggugagcauccuccugagcucccugcucaagaacgacgucccccuggccggcccccugaucgccggcgggaugcucaucgccugcuacgugaucagcggcuccagcgcggaccugucccuggagaaggccgccgaggugagcugggaggaggaggccgagcacuccggggccagccacaacauccucgucgaggugcaggacgacggcaccaugaagaucaaggacgaggagcgggacgacacccugaccauccugcucaaggcgacgcugcuggccguguccggggucuacccgcucagcauccccgccacccuguucgugugguacuucuggcagaagaagaagcagcgcuccggcgugcugugggacacccccagcccgcccgaggucgagcgggccgugcuggacgacggcaucuaccgcaucaugcagcgggggcuccugggccgcucccaggugggggucggcguguuccaggagaacguguuccacaccauguggcacgucacgcgcggggccgugcugauguaccagggcaagcgccucgagcccagcugggcguccgugaagaaggaccugaucagcuacggcgggggcuggcggcugcagggguccuggaacaccggcgaggagguccaggugaucgccguggagcccgggaagaaccccaagaacguccagaccgcccccggcaccuucaagacgcccgagggcgaggugggggccaucgcccucgacuucaagcccggcaccagcgggucccccaucgugaaccgcgagggcaagaucgucggccuguacgggaacggcguggugaccaccagcgggacguacgucagcgcgaucgcccaggccaaggccucccaggagggcccgcugcccgagaucgaggacgagguguuccggaagcgcaaccucaccaucauggaccugcaccccgggagcggcaagacccggcgcuaccugccggcgaucgugcgggaggccaucaagcgcaagcuccggacccugauccuggcccccacgcgcgucguggccuccgagauggccgaggcgcucaagggcaugcccauccgcuaccagaccaccgccgucaagagcgagcacaccgggaaggagaucgucgaccugaugugccacgccacguucaccaugcggcugcucucccccgugcgcgugccgaacuacaacaugaucaucauggacgaggcccacuucaccgaccccagcuccaucgccgcgcggggcuacaucagcacccgcgucgggaugggcgaggccgccgccaucuucaugacggccacgccgcccggguccguggaggcguucccgcagagcaacgccgugauccaggacgaggagcgggacauccccgagcgcuccuggaacagcggcuacgaguggaucaccgacuuccccggcaagaccgucugguucgugcccuccaucaagagcgggaacgacaucgccaacugccugcggaagaacggcaagcgcgugauccagcugucccggaagacguucgacaccgaguaccagaagaccaagaacaacgacugggacuacgucgugaccacggacaucagcgagaugggggccaacuuccgcgcggaccgggugaucgacccgcgccggugccucaagcccgucauccugaaggacggccccgagcgcgugauccuggccgggcccaugccggucaccguggccuccgccgcccagcggcgcggccggaucggccgcaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgggagaaguccgccgccaucgacggcgaguaccgccugcgcggggaggcgcggaagacguucguggagcugaugcgccggggcgaccuccccgucuggcuguccuacaagguggccagcgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccgggggcgugacccuguucuuccucuccgggcggggccugggcaagaccagcaucgggcugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucggccuccucuucaugauccugaccguggccgccaacgagauggggcugcucgagaccaccaagaaggaccugggcaucgggcacgucgcgguggagaaccaccaccacgccacgaugcuggacguggaccuccaccccgccuccgccuggacccuguacgccgucgcgaccaccaucaucacgccgaugaugcgccacaccaucgagaacaccaccgccaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcgcacuacgccaucaucgggccgggccuccaggccaaggccacccgggaggcccagaagcgcacggcggccgggaucaugaagaaccccaccguggacggcaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcuccccggggaaguucuggaacaccaccaucgccgucagcauggccaacaucuuccggggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaucuacaagcgguccggcaucauggagguggaccgcagcgaggccaaggaggggcugaagcggggcgagaccacccgccacgccgugucccgggggaccgcgaagcugcgcugguucgucgagcggaaccuggugaagcccgagggcaaggugaucgaccucggcugcgggcgcggcggguggagcuacuacugcgccggccugaagaaggucacggaggugaagggguacaccaagggcggccccgggcacgaggagcccaucccgauggccaccuacggcuggaaccuggugaagcuccacuccgggaaggacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacccacgagauguacugggucuccugcggcacggggaacaucgugagcgccgugaacaugaccucccggaugcugcugaaccgcuucaccauggcccaccgcaagcccaccuacgagcgggacgucgaccucggcgcgggcacgcgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggugaagcugcucaccaagcccugggacgucauccccauggugacgcagaucgcgaugaccgacaccacccccuucgggcagcagcgcguguucaaggagaaggucgacacgcggaccccgaaggccaagcgcggcaccgcccagaucauggaggugaccgcccgguggcuguggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccucguccagaaggagcgcgagcugcacaagcagggcaagugcgcgaccugcguguacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgggugcagcgccccgcgaagaacggcaccgucauggacgugaucagccgccgggaccagcgcggguccggccaggugggcaccuacgggcugaacaccuucacgaacauggaggcccagcucauccggcagauggagagcgagggcaucuuccugcccuccgagcuggagacccccaaccucgccgagcgcguccuggacuggcuggagaaguacgggguggagcggcucaagcgcauggccaucagcggcgacgacugcguggucaagccgaucgacgaccgguucgccaccgcgcuggccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagaccgcgugccucggcaagagcuacgcccagauguggcagcugauguacuuccaccgccgggaccugcgccucgccgccaacgcgaucugcuccgccgugcccguggacuggguccccacgagccggaccaccugguccauccacgcccaccaccaguggaugaccacggaggacaugcugagcguguggaaccgcguguggaucgaggagaaccccuggauggaggacaagacccacgucuccagcuggggcgacgugccguaccugggcaagcgggaggaccaguggugcggcucccucaucgggcugaccgcccgcgccaccugggcgagcaacauccagguggccaucaaccagguccgccggcugaucggcaacgagaacuaccucgacuacaugaccuccaugaagcgcuucaagaacgagggggaccccgagggcgcccugugguga

SEQ ID NO: 8753 - RNA, 9879 nt, Artificial Sequence
  derived and/or modified CDS sequence (opt1) from DENV-1__EU482477__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccuggagaacaucauguggaagcagaucagcaacgagcucaaccacauccugcuggagaacgacaugaaguucaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucaaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgaugcucgccgugggccugcuguuccggcgccucaccagccgggaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucaucaagacgaccuacagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgcgaggggaagaucgugggccucuacggcaacggggucgugacgaccuccggcaccuacgugagcgccaucgcccaggccaaggcgucccaggaggggccccugccggagaucgagaacgaggucuuccggaagcgcaaccugaccaucauggaccuccaccccggcagcgggaagacgcggcgcuaccugcccgccaucgugcgggaggccaucaagcgcaagcugcggacccucauccuggccccgacccgcguggucgccuccgagauggcggaggcccugaagggcaugcccauccgcuaccagaccacggccgucaagagcgagcacaccggcaaggagaucguggaccucaugugccacgccaccuucaccaugcggcugcugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccucaaggacgggcccgagcgcgucauccuggccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgggagaaguccgccgcgaucgacggggaguaccgccuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgcggccggccgccggagcgucuccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacccugaugcuccuggcccugaucgccgugcucacgggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacgcgggaggcccagaagcgcaccgccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagaccacgaagcacgccgugucccgcggcaccgccaagcugcggugguucguggagcgcaaccuggucaagccggaggggaaggugaucgaccugggcugcggccgcggcggguggagcuacuacugcgccgggcucaagaaggugaccgaggucaagggguacaccaagggcgggcccggccacgaggagcccauccccauggccacguacggguggaaccuggugaagcugcacuccggcaaggacguguucuucaucccgcccgagaagugcgacacccuccugugcgacaucggggagagcucccccaaccccaccaucgaggagggccgcacccugcggguccucaagaugguggagccguggcugcgcgggaaccaguucugcaucaagauccugaaccccuacaugcccagcguggucgagacgcucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgguucaccauggcccaccgcaagccgacguacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggccaaguccaucuucaagcucacguaccagaacaaggugguccgcgugcagcggccggccaagaacgggaccgugauggacgucaucagccgccgcgaccagcggggcuccggccaggugggcaccuacggccugaacaccuucacgaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagacggccugccugggcaaguccuacgcccagauguggcagcugauguacuuccaccggcgcgaccuccggcuggccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacaucagcuccuggggcgacgugcccuaccucggcaagcgcgaggaccaguggugcggcagccugaucgggcugaccgcccgggcgacgugggccaccaacauccaggucgccaucaaccaggugcgccgccucaucggcaacgagaacuaccuggacuacaugaccuccaugaagcgguucaagaacgagagcgacccggagggggcccugugguga

SEQ ID NO: 8754 - RNA, 9879 nt, Artificial Sequence
  derived and/or modified CDS sequence (opt1) from DENV-1__EU482478__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacucccacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucguccgggaggccaucaagcgcaagcugcgcacccucauccuggcccccacgcgggugguggccagcgagauggccgaggcgcugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugacggccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgccaacuuccgcgcggaccgggucaucgacccgcgccggugccugaagcccgugauccucaaggacgggcccgagcgcgugauccuggccggccccaugccggucaccguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugacgagccgcaugcuccugaaccgcuucaccauggcgcaccggaagcccaccuacgagcgcgacguggaccugggggccggcacccggcacguggccgucgagcccgagaucgccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugagccgcaacaagaagccccggaucugcacccgcgaggaguucacgcggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgcgugccugggcaagagcuacgcccagauguggcagcugauguacuuccaccgccgggaccuccgccuggccgccaacgcgaucugcuccgccgugcccguggacuggauccccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccaggucgccaucaaccaggugcgccggcucaucgggaacgagaacuaccuggacuacaugaccagcaugaagcgcuucaagaacgagggcgaccccgagggggcccugugguga

SEQ ID NO: 8755 - RNA, 9879 nt, Artificial Sequence
  derived and/or modified CDS sequence (opt1) from DENV-1__EU482479__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaucugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucguggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucgggcuccuguucaugauccugaccguggccgccaacgagaugggccuccuggagaccaccaagaaggaccuggggaucggccacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgucccccuccuggcccuggggugcuacagccaggugaacccccucacgcugaccgccgcggugcugaugcucgucgcccacuacgccaucaucggcccggggcugcaggccaaggccacccgcgaggcgcagaagcggaccgccgccggcaucaugaagaaccccacgguggacgggaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggccaaggagggccugaagcgcggggagaccaccaagcacgcggugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgacgaucgaggagggccgcacccugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgccgugaacaugacgucccgcaugcugcucaaccgcuucaccauggcgcaccggaagcccaccuacgagaaggacguggaccugggggccggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgccaaguggcuguggggcuuccucucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggcccggaucaccgacaucauggagccggagcacgcccuccuggcgaaguccaucuucaagcugaccuaccagaacaaggugguccgcgugcagcgccccgccaagaacgggaccgugauggacgucaucagccggcgcgaccagcggggcuccggccagguggggacguacggccucaacaccuucaccaacauggaggcccagcugauccgccagauggagagcgaggggaucuucucccccagcgagcuggagacccccaaccucgccgagcgggugcuggacuggcugaagaaguacggcgucgagcgccucaagcggauggccaucuccggggacgacugcguggugaagccgaucgacgaccgcuucgcgacggcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcacgaccuggagcauccacgcccaccaccaguggaugaccaccgaggacaugcuguccguguggaaccgggucuggaucgaggagaaccccuggauggaggacaagacgcacaucagcuccuggggcgacgugccguaccuggggaagcgcgaggaccaguggugcggcagccucaucggccugaccgcccgcgccaccugggcgaccaacauccagguggccaucaaccagguccggcgccugaucgggaacgagaacuaccucgacuacaugaccuccaugaagcgguucaagaacgagggcgaccccgagggggcccugugguga

SEQ ID NO: 8756 - RNA, 9879 nt, Artificial Sequence
  derived and/or modified CDS sequence (opt1) from DENV-1__EU482480__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucaccgaggccgagcccgacgacguggacugcuggugcaacgccaccgacacgugggucaccuacgggaccugcacccagaucggcgagcaccggcgcgacaagcggagcguggcccuggcgccccacgugggccucgggcuggagacgcggaccgagaccuggauguccagcgagggcgccuggaagcagauccagcgggucgagaccugggcccugcgccaccccggguucacggugaucgcccucuuccuggcgcacgccaucggcaccuccaucacccagaaggggaucaucuucauccugcucaugcuggccacccccagcauggccaugcggugcgugggcaucggcucccgcgacuucgucgaggggcugagcggcgccacguggguggacgugguccucgagcacggguccugcgugaccaccauggcgaaggacaagcccacccuggacaucgagcugcucaagacggaggugaccaaccccgccguccugcggaagcugugcaucgaggccaagaucagcaacaccaccacggacucccgcugcccgacccagggcgaggccacccucguggaggagcaggacgccaacuucgugugccggcgcaccuucgucgaccggggcugggggaacggcugcgggcuguucggcaaggggagccugaucacgugcgcgaaguucaagugcgugaccaagcucgagggcaagaucgugcaguacgagaaccugaaguacuccgucaucgugaccgugcacaccggcgaccagcaccaggucgggaacgagagcacggagcacggcaccaucgccaccaucacgccccaggcccccuccaccgagauccagcugacggacuacggggcccucacccuggacugcagcccccgcaccggccuggacuucaacgagauggugcuccugaccaugaaggagaaguccuggcugguccacaagcagugguuccucgaccugccgcugcccuggacgagcggggccagcaccucccaggagaccuggaaccggcaggaccuccuggugaccuucaagacggcgcacgccaagaagcaggagguggucgugcugggcagccaggagggcgccaugcacaccgcccucaccggggccaccgagauccagacguccggcaccaccaccaucuucgcggggcaccugaagugccgccugaagauggacaagcucacgcugaagggcaugagcuacgugaugugcaccggguccuucaagcuggagaaggaggucgccgagacccagcacggcaccgugcucgugcagaucaaguacgagggcacggacgcccccugcaagauccccuucagcacccaggacgagaagggggucacccagaacggccggcugaucaccgccaacccgaucgugacggacaaggagaagcccgugaacaucgaggcggagccgcccuucggggaguccuacaucgucaucggcgccggcgagaaggcccugaagcugagcugguucaagaagggguccagcaucggcaagauguucgaggccaccgcccgcggggcgcggcgcauggccauccucggcgacaccgccugggacuucggguccaucggcggcguguucaccagcguggggaagcugguccaccagaucuucggcacggccuacggggugcuguucuccggcgugagcuggaccaugaagaucgggaucggcguccuccugaccuggcugggccucaacucccgcagcaccucccugagcaugacgugcaucgccguggggcuggugacccucuaccugggcgucauggugcaggcggacuccgggugcgugaucaacuggaagggccgggagcugaagugcgggagcggcaucuucgucaccaacgaggugcacaccuggacggagcaguacaaguuccaggccgacagcccgaagcgccucuccgccgccaucggcaaggccugggaggagggggugugcggcauccggagcgcgacccgccuggagaacaucauguggaagcagaucuccaacgagcugaaccacauccuccuggagaacgacaugaagcugaccgucguggugggggacgucgccggcauccucgcccaggggaagaagaugauccggccccagcccauggaguacaaguacagcuggaagaucuggggcaaggccaagaucaucggcgcggacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacuccuacacccaggucugcgaccaccgccucaugagcgccgccaucaaggacuccaaggccgugcacgcggacaugggcuacuggaucgagagcgagaagaacgagacguggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgugguggucgacgagcacugcggcaaccgggggccgagccugcgcaccacgaccgugaccggcaagaucauccacgaguggugcugccgguccugcacccugccgccccuccgcuucaagggggaggacggcugcugguacgggauggagauccggcccgugaaggagaaggaggagaaccuggucaagagcaugguguccgccggcagcggcgagguggacagcuucucccucgggcugcugugcaucagcaucaugaucgaggaggucaugcgcucccgguggagccgcaagaugcucaugacgggcacccuggcgguguucuuccugcucaucauggggcagcugaccuggaacgaccugauccggcucugcaucauggugggcgccaacgccuccgaccgcauggggaugggcaccacguaccuggcccugauggccaccuucaagaugcgcccgauguucgcggucggccuccuguuccggcgccugaccagccgggaggugcuccugcugaccaucgggcucucccugguggccagcgucgagcugcccaacucccucgaggagcugggcgacgggcuggccaugggcaucaugauccucaagcugcugacggacuuccagagccaccagcucugggccacccugcugucccucaccuucauccgcaccacguucagccugcacuacgcguggaagaccauggccauggugcuguccaucgucagccucuucccccugugccuguccaccaccagccagaagacgaccuggcuccccgugcugcugggcucccucgggugcaagccgcugaccauguuccugaucgccgagaacaagaucuggggccggaaguccuggccccucaacgaggggaucauggccgugggcaucgucuccauccugcugagcagccuccugaagaacgacgugccccuggccgggccccucaucgcgggcggcaugcugaucgccugcuacgugaucuccgggagcuccgccgaccugagccucgagaaggccgccgaggucuccugggaggaggaggcggagcacagcggcgccucccacaacauccugguggaggugcaggacgacgggaccaugaagaucaaggacgaggagcgcgacgacacgcugaccauccuccugaaggccacccugcucgccgucagcggcguguacccgcuguccauccccgccacccuguucgugugguacuucuggcagaagaagaagcagcggagcgggguccucugggacacccccagcccgcccgagguggagcgcgcggugcuggacgacggcaucuaccggaucaugcagcgcggccugcuggggcggagccaggucggcguggggguguuccaggagaacgucuuccacacgauguggcacgugacccgcggcgccgugcucauguaccaggggaagcggcuggagcccuccugggccagcgucaagaaggaccugaucuccuacggcggcggguggcgccuccagggcagcuggaacaccggggaggagguccaggugaucgccgucgagcccggcaagaaccccaagaacgugcagaccgcccccgggacguucaagaccuccgagggcgaggugggcgcgaucgcccuggacuucaagcccgggaccagcggcucccccaucgucaaccgggaggggaagaucgugggccuguacggcaacgggguggucaccacgagcggcaccuacgugagcgccaucgcccaggcgaaggccucccaggaggggccccucccggagaucgaggacgagguguuccgcaagcggaaccugaccaucauggaccugcaccccggcagcgggaagacccgccgguaccuccccgccaucguccgcgaggccaucaagcggcgccugcgcacgcugauccucgccccgacccgggugguggcguccgagauggccgaggcccugaagggcaugcccauccgcuaccagaccaccgccgucaagagcgagcacacgggcaaggagaucguggaccugaugugccacgccaccuucaccaugcggcuccugucccccgugcgcguccccaacuacaacaugaucaucauggacgaggcgcacuucaccgacccgagcuccaucgccgcccggggguacaucagcacgcgcgugggcaugggggaggccgccgcgaucuucaugaccgccacgccgcccggcuccguggaggccuucccccagagcaacgccgucauccaggacgaggagcgggacaucccggagcgcuccuggaacagcggguacgaguggaucaccgacuuccccggcaagacggugugguucgugcccuccaucaagagcggcaacgacaucgcgaacugccugcggaagaacgggaagcgcgucauccagcucucccggaagaccuucgacaccgaguaccagaagaccaagaacaacgacugggacuacguggugacgaccgacaucagcgagaugggcgccaacuuccgcgccgaccgggucaucgacccccgccggugccugaagccggugauccugaaggacgggcccgagcgcgugauccucgccggccccaugcccgucaccguggccuccgcggcccagcggcgcgggcggaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgcgagaaguccgcggccaucgacggggaguaccggcugcgcggcgaggcccggaagaccuucgucgagcucaugcgccgcggggaccugccgguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcgcugcgggaguucaaggaguucgccgccggccgccggagcguguccggggaccugauccucgagaucggcaagcugccccagcaccugacgcagcgcgcccagaacgcgcucgacaaccuggucaugcugcacaacagcgagcagggcgggcgggccuaccgccacgccauggaggagcucccggacaccaucgagacccugaugcugcucgcccugaucgccgugcugaccggcggggugacccuguucuuccuguccggccgggggcugggcaagaccagcaucggccuccugugcgucauggcguccagcgugcugcucuggauggccuccguggagccccacuggaucgccgccagcaucauccuggaguucuuccugaugguccuccugauccccgagcccgaccgccagcggaccccgcaggacaaccagcuggccuacguggugaucgggcuccuguucaugauccugaccgucgcggccaacgagaugggccuccuggagaccacgaagaaggaccuggggaucggccacguggccguggagaaccaccaccacgccgccaugcucgacgucgaccugcaccccgcguccgccuggacccuguacgccguggccaccaccaucaucacgcccaugaugcgccacaccaucgagaacaccaccgccaacaucagccucacggcgaucgccaaccaggccgccauccugauggggcuggacaagggcuggccgaucuccaagauggacaucggcgugccccuccuggcgcuggggugcuacagccaggucaacccccucacccugaccgccgccgugcugaugcucguggcccacuacgccaucaucggccccgggcugcaggcgaaggccacccgcgaggcccagaagcggacggccgccggcaucaugaagaacccgaccgucgacgggaucguggcgaucgaccuggaccccguggucuacgacgccaaguucgagaagcagcucggccagaucaugcugcugauccucugcaccucccagauccugcugaugcgcaccacgugggcccucugcgagagcaucacccuggccaccggcccccugaccacgcucugggaggggucccccggcaaguucuggaacaccaccaucgccgugagcauggcgaacaucuuccggggguccuaccuggccggcgccggccuggccuucagccucaugaagucccucgggggcgggcgccgggggaccggggcgcagggcgagacgcugggcgagaaguggaagcgccagcucaaccagcuguccaagagcgaguucaacaccuacaagcgguccgggaucauggagguggaccgcagcgaggccaaggagggccugaagcgcggggagaccaccaagcacgccgucucccgcggcacggccaagcuccggugguucguggagcgcaaccuggugaagccggaggggaaggucaucgaccugggcugcggccgcggcggguggagcuacuacugcgccgggcugaagaaggugaccgaggugaagggguacaccaagggcggccccggccacgaggagcccauccccauggcgaccuacggguggaaccucgucaagcugcacuccggcaaggacguguucuucaucccgcccgagaagugcgacacgcugcucugcgacaucggggagagcucccccaaccccaccaucgaggagggccgcacccugcgggugcugaagauggucgagccguggcuccgcgggaaccaguucugcaucaagauccugaaccccuacaugcccagcgugguggagacccuggagcagaugcagcggaagcacggcggcaugcucguccgcaacccccugucccggaacagcacgcacgagauguacuggguguccugcgggaccggcaacaucgugagcgccgucaacaugaccucccgcaugcugcucaaccgcuucaccauggcccaccggaagccgaccuacgagcgcgacguggaccugggggccggcacgcggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagcccagcggcuccgccagcagcauggucaacgggguggucaagcuccugaccaagccgugggacgugauccccauggugacgcagaucgccaugaccgacaccacccccuucggccagcagcgggucuucaaggagaagguggacacgcgcacccccaaggccaagcgggggaccgcgcagaucauggaggugaccgccaaguggcuguggggcuuccucucccgcaacaagaagccgcggaucugcacgcgcgaggaguucacccggaagguccgcagcaacgccgccaucggcgcgguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacgcggaucaccgaggacgaccugcagaacgaggcgaagaucaccgacaucauggagcccgagcacgcccuccuggccaaguccaucuucaagcugaccuaccagaacaagguggugcgcguccagcgcccggccaagaacgggacggugauggacgugaucagccggcgcgaccagcggggcuccgggcaggucggcaccuacggccucaacaccuucaccaacauggaggcccagcugauccgccagauggagagcgaggggaucuucucccccagcgagcuggagacgcccaaccucgcgggccgggugcuggacuggcuggagaagcacgggguggagcgccucaagcggauggccaucuccggcgacgacugcgucgugaagcccaucgacgaccgcuucgccaccgcccugaccgcccugaacgacauggggaaggugcggaaggacaucccgcagugggagcccagcaagggcuggaacgacuggcagcagguccccuucugcucccaccacuuccaccagcucaucaugaaggacggccgcgagaucguggugcccugccggaaccaggacgagcuggucgggcgcgcgcgggugagccagggcgccggguggagccugcgcgagaccgccugccucggcaaguccuacgcccagauguggcagcugauguacuuccaccggcgcgaccugcggcucgcggccaacgccaucugcagcgccgugccggucgacugggugcccacgucccgcaccaccuggagcauccacgcccaccaccaguggaugaccacggaggacaugcuguccguguggaaccgggucuggaucgaggagaaccccuggauggaggacaagacccacgugagcuccuggggcgacgugcccuaccugggcaagcgcgaggaccaguggugcggcagccucaucgggcugaccgcgcgcgccaccugggccacgaacauccaggucgccaucaaccaggugcggcgccugcucggcaacgagaacuaccuggacuacaugaccuccaugaagcgguucaagaacgagagcgacccggagggggcccugugguga

SEQ ID NO: 8757 - RNA, 9879 nt, Artificial Sequence
  derived and/or modified CDS sequence (opt1) from DENV-1__EU482481__SS-prME
agcgugaccaugcugcucaugcugaugcccaccgcccuggccuuccaccucaccacccggggcggggagccccacaugaucgugaccaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccgugggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcgcaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggugugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacgcuguggagcaacggcgugcucgaguccgagaugaucauccccaagaucuacgggggcccgaucagccagcacaaccaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugacguggaacgaccucauccggcugugcaucauggugggcgccaacgcgagcgaccgcauggggaugggcaccaccuaccuggcccucauggccaccuucaagaugcgcccgauguucgccgugggccugcuguuccggcgccucacgucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgugucccuguucccccucugccugagcacgaccucccagaagaccaccuggcugcccguccuccugggcagccuggggugcaagccgcucacgauguuccugaucaccgagaacaagaucuggggccgcaaguccuggccccugaacgaggggaucauggcggugggcguggucagcauccuccugagcucccugcucaagaacgacgugccccuggccgggccccugaucgccggcggcaugcucaucgccugcuacgugaucagcggguccagcgccgaccugucccuggagaaggcggccgaggucagcugggaggaggaggccgagcacuccggcgccagccacaacauccucguggaggugcaggacgacgggaccaugaagaucaaggacgaggagcgggacgacacccugaccauccugcucaaggccacgcugcuggcggucuccggcguguacccgcucagcauccccgccacccuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacgcggggcgccgugcugauguaccaggggaagcgccucgagcccagcugggccuccgucaagaaggaccugaucagcuacggcggcggguggcggcugcagggcuccuggaacaccggggaggagguccaggugaucgcggucgagcccggcaagaaccccaagaacgugcagaccgcccccgggaccuucaagacgcccgagggcgaggugggcgccaucgcccucgacuucaagcccgggaccagcggcucccccaucgucaaccgcgaggggaagaucgugggccuguacggcaacgggguggucaccaccagcggcacguacgugagcgccaucgcgcaggccaaggccucccaggaggggccgcugcccgagaucgaggacgagguguuccggaagcgcaaccucaccaucauggaccugcaccccggcagcgggaagacccggcgcuaccugccggccaucguccgggaggcgaucaagcgcaagcuccggacccugauccuggcccccacgcgcgugguggccuccgagauggccgaggcccucaagggcaugcccauccgcuaccagaccaccgcggucaagagcgagcacaccggcaaggagaucguggaccugaugugccacgccacguucaccaugcggcugcucucccccgugcgcgucccgaacuacaacaugaucaucauggacgaggcccacuucaccgaccccagcuccaucgccgcccggggguacaucagcacccgcgugggcaugggggaggcggccgccaucuucaugacggccacgccgcccggcuccguggaggccuucccgcagagcaacgcggucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccgcgccggugccucaagcccgugauccugaaggacgggcccgagcgcgucauccuggcgggccccaugccggugaccguggccuccgccgcccagcggcgcgggcggaucggccgcaaccacaacaaggagggcgaccaguacaucuacauggggcagccccucaacaacgacgaggaccacgcccacuggaccgaggcgaagaugcugcuggacaacaucaacacccccgagggcaucauccccgcccucuucgagccggagcgggagaaguccgccgccaucgacggggaguaccgccugcgcggcgaggcccggaagacguucgucgagcugaugcgccgcggggaccuccccguguggcuguccuacaagguggcgagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgccggccgccggagcguguccggggaccugaucagcgagaucggcaagcugccgcagcaccucacccagcgcgcgcagaacgcccuggacaaccuggucaugcuccacaacuccgagcagggcgggcgggccuaccgccacgccauggaggagcugcccgacacgaucgagacccugaugcuccuggcgcugaucgccgugcucaccggcggggugacccuguucuuccugagcggccgggggcucggcaagaccuccaucggccugcugugcgucauggccagcuccgugcuccuguggauggccagcguggagccccacuggaucgccgcguccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggccguggagaaccaccaccacgcgacgaugcuggacgucgaccugcaccccgccagcgccuggacccucuacgccguggccaccaccaucaucacgccgaugaugcgccacaccaucgagaacaccaccgcgaacaucucccugacggccaucgccaaccaggccgccauccugauggggcucgacaagggcuggcccaucagcaagauggacaucggcgugccccugcuggcgcucgggugcuacucccaggucaacccccugacccugaccgccgccgugcucaugcugguggcccacuacgcgaucaucggcccggggcugcaggccaaggccacccgggaggcccagaagcgcacggccgcgggcaucaugaagaaccccaccgucgacgggaucaucgccaucgaccucgaccccgugguguacgacgccaaguucgagaagcagcugggccagaucaugcugcucauccugugcaccagccagauccugcucaugcgcaccacgugggcccugugcgaguccaucacccuggccaccggcccccucaccacgcugugggaggggagcccgggcaaguucuggaacaccaccaucgcggucuccauggccaacaucuuccgggggagcuaccuggccggcgccggccucgccuucagccugaugaagucccucgggggcgggcgccgggggaccggggcgcagggcgagacgcucggcgagaaguggaagcgccagcugaaccagcugagcaaguccgaguucaacaucuacaagcggagcgggaucauggagguggaccgcuccgaggccaaggagggccucaagcgcggggagaccacccgccacgccgugagccggggcaccgccaagcugcgcugguucgucgagcggaaccuggugaagcccgaggggaaggugaucgaccugggcugcggccgcgggggcugguccuacuacugcgcggggcucaagaaggucacggaggugaagggcuacaccaagggcgggcccggccacgaggagcccaucccgauggccaccuacggguggaaccuggugaagcugcacagcggcaaggacgucuucuucacgccgcccgagaagugcgacacgcuccugugcgacaucggggaguccagccccaacccgaccaucgaggagggccggacccugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggacgggcaacaucguguccgccgugaacaugaccagccggaugcuccugaaccgcuucaccauggcccaccgcaagcccaccuacgagcgggacgucgaccugggggccggcacgcgccacguggcgguggagcccgaggucgccaaccucgacaucaucggccagcggaucgagaacaucaagcacgagcacaaguccaccuggcacuacgacgaggacaaccccuacaagaccugggccuaccacgggagcuacgaggugaagccguccggcagcgccagcuccauggucaacgggguggugaagcugcugaccaagcccugggacgucauccccauggugacgcagaucgccaugaccgacaccacccccuucggccagcagcgcguguucaaggagaaggucgacacgcggaccccgaaggcgaagcgcgggaccgcccagaucauggaggugaccgcccgguggcucuggggcuuccugagccgcaacaagaagccccggaucugcacgcgcgaggaguucacccggaaggugcgcuccaacgccgccaucggcgcggucuucguggacgagaaccaguggaacagcgccaaggaggccguggaggacgagcgguucugggaccugguccagaaggagcgcgagcuccacaagcaggggaagugcgcgaccugcguguacaacaugaugggcaagcgggagaagaagcugggggaguucggcaaggcgaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacaccgcgggcugggacacgcgcaucaccgaggacgaccuccagaacgaggccaagaucaccgacaucauggagccggagcacgcccugcuggccaccagcaucuucaagcucacguaccagaacaaggucgugcgggugcagcgccccgccaagaacgggaccgucauggacgugaucucccgccgggaccagcgcggcagcggccaggugggcaccuacggccugaacaccuucacgaacauggaggcgcagcugauccggcagauggaguccgaggggaucuuccuccccagcgagcuggagacccccaaccuggccgagcgcguccucgacuggcuggagaaguacggcguggagcggcugaagcgcauggccaucuccggggacgacugcguggucaagccgaucgacgaccgguucgccaccgcccucaccgcgcugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagacggccugccuggggaaguccuacgcccagauguggcagcucauguacuuccaccgccgggaccugcgccuggcggccaacgccaucugcagcgccgugcccguggacuggguccccaccucccggaccaccuggagcauccacgcgcaccaccaguggaugacgaccgaggacaugcucuccguguggaaccgcguguggaucgaggagaaccccuggauggaggacaagacccacgucagcuccuggggcgacgugccguaccuggggaagcgggaggaccaguggugcggcagccugaucggccucaccgcccgcgccaccugggccuccaacauccagguggccaucaaccagguccgccggcugaucgggaacgagaacuaccuggacuacaugacgagcaugaagcgcuucaagaacgagggcgaccccgagggggcgcucugguga

SEQ ID NO: 8758 - RNA, 9879 nt, Artificial Sequence
  derived and/or modified CDS sequence (opt1) from DENV-1__EU482482__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccaagcgcgugcuggacuggcucgagaaguacggcguggagcggcugaagcgcauggccaucuccggggacgacugcgucgugaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8759 - RNA, 9879 nt, Artificial Sequence
  derived and/or modified CDS sequence (opt1) from DENV-1__EU482485__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaacauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccaccaagaacggcacggugauggacgucaucagccgccgggaccagcgcggguccggccaggugggcaccuacgggcucaacaccuucaccaacauggaggcccagcugauccggcagauggagagcgagggcaucuucucccccagcgagcuggagacgcccaaccucgccgagcgcgugcuggacuggcuggagaaguacggggucgagcggcucaagcgcauggccaucuccggcgacgacugcguggugaagccggucgacgaccgguucgccaccgcgcugaccgcccugaacgacauggggaaggugcgcaaggacaucccccagugggagcccagcaagggcuggaacgacuggcagcagguccccuucugcucccaccacuuccaccagcucaucaugaaggacggccgggagaucgucgugccgugccgcaaccaggacgagcugguggggcgggcccgcgucagccagggcgccggguggagccugcgggagaccgccugccucggcaaguccuacgcgcagauguggcagcugauguacuuccaccgccgggaccugcgccucgccgccaacgccaucugcagcgcggugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccugggcaagcgcgaggaccaguggugcggcagccucaucgggcugaccgcccgggccaccugggccaccaacauccaggucgcgaucaaccaggugcgccggcugaucggcaacgagaacuaccucgacuacaugacguccaugaagcgcuucaagaacgagagcgaccccgagggggcccugugguga

SEQ ID NO: 8760 - RNA, 9879 nt, Artificial Sequence
  derived and/or modified CDS sequence (opt1) from DENV-1__EU482486__SS-prME
uccgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggcuguucaagcuggagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcucaagcugagcugguucaagaagggguccagcaucggcaagauguucgaggccaccgcccgcggggcccgccggauggccauccugggcgacaccgcgugggacuucggguccaucggcggcgucuucacgagcguggggaagcucgugcaccagaucuucggcaccgccuacgggguccuguucuccggcgugagcuggaccaugaagaucgggaucggcgugcugcucaccuggcugggccugaacucccgcagcacgucccucagcaugaccugcaucgccgucgggcuggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggcgccagaucuccaacgagcugaaccacauccugcucgagaacgacaugaaguucaccguggucgugggggacguggucggcauccuggcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcuccgggacagcuacacgcaggucugcgaccaccgccugauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggcccgaucagccagcacaacuaccgccccggguacuucacgcagaccgcgggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgugaaggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacccuggccguguucuuccuccugaucauggggcagcugaccuggaacgaccucauccggagcugcaucauggugggcgccaacgccuccgaccgcauggggaugggcacgaccuaccuggcgcugauggccaccuucaagaugcgcccgauguucgccgucggccuccuguuccggcgccugaccagccgggaggugcuccugcugacgaucgggcucucccuggucgccagcguggagcugcccaacucccucgaggagcugggcgacgggcuggccaugggcaucaugauccucaagcugcugaccgacuuccagagcuaccagcucugggcgacccugcugucccucaccuucaucaagacgaccuucagccugcacuacgccuggaagaccauggccauggugcuguccaucgucagccuccugccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgggacgacacccucaccauccugcugaaggccacccuccuggcggucagcggcguguacccgcuguccauccccgccacccucuucgugugguacuucuggcagaagaagaagcagcgcagcgggguccugugggacacgcccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccucuacggcaacgggguggucacgaccagcggcaccuacguguccgccaucgcgcaggccaaggccagccaggaggggccgcugcccgagaucgaggacgagguguuccggaagcgcaaccugaccaucauggaccuccaccccggcuccgggaagacgcggcgcuaccugccggccaucguccgggaggcgaucaagcgcaagcugcggacccucauccuggcccccacccgcgugguggccagcgagauggccgaggcccugaagggcaugcccauccgcuaccagaccacggcggucaaguccgagcacaccggccgggagaucguggaccucaugugccacgccaccuucaccaugcgccugcugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcguggaggccuucccgcaguccaacgcggucauccaggacgaggagcgcgacauccccgagcggagcuggaacuccggguacgaguggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccgcggcgcugccugaagcccgugauccucaaggacgggcccgagcgggucauccuggcgggccccaugccggugaccguggccagcgccgcccagcgccgggggcgcaucggccggaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgcgagaaguccgccgccaucgacggggaguaccgccuccggggcgaggcccgcaagaccuucgucgagcugaugcggcgcggggaccugcccguguggcucagcuacaagguggcgagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgccgccggccggcgcuccgugagcggggaccucauccuggagaucggcaagcugccgcagcaccucacccagcgggcgcagaacgcccuggacaaccuggucaugcuccacaacuccgagcagggcgggcgcgccuaccggcacgccauggaggagcugcccgacaccaucgagacccugaugcuccuggcgcugaucgccgugcucacgggcggggugacccuguucuuccugagcggccgcgggcucggcaagaccuccaucggccugcugugcgucauggccagcuccgcccuccuguggauggccagcguggagccccacuggaucgcggccuccaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagacgaccaagaaggaccucgggaucggccacgucgcgguggagaaccaccaccacgccaccaugcuggacguggaccugcaccccgccagcgccuggacccucuacgccgucgcgacgaccaucaucaccccgaugaugcggcacaccaucgagaacacgaccgccaacaucucccugaccgccaucgccaaccaggccgcgauccugauggggcucgacaagggcuggcccaucagcaagauggacaucggcgugccccugcuggcccucgggugcuacucccaggugaacccccugacccugacggccgccguccucaugcugguggcgcacuacgccaucaucggcccggggcugcaggccaaggccacccgcgaggcccagaagcgcaccgcggccggcaucaugaagaaccccaccguggacgggaucgucgccaucgaccucgaccccgugguguacgacgccaaguucgagaagcagcugggccagaucaugcugcucauccugugcacgagccagauccugcucaugcggaccaccugggcccugugcgaguccaucacccuggcgacgggcccccucaccacccugugggaggggagcccgggcaaguucuggaacaccacgaucgccgucuccauggccaacaucuuccgcgggagcuaccuggccggcgccggccucgcguucagccugaugaagucccucgggggcgggcggcgcgggaccggggcccagggcgagacccucggcgagaaguggaagcggcagcugaaccagcugagcaaguccgaguucaacaccuacaagcgcagcgggaucauggagguggaccgguccgaggccaaggagggccuccgccgcggggagacgaccaagcacgccgugagccgcggcaccgcgaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcggccccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccgcacgcugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugaccagccgcaugcuccugaaccgcuucacgauggcccaccggaagcccaccuacgagcgcgacgucgaccugggggcgggcacccggcacguggccguggagcccgaggucgccaaccucgacaucaucggccagcgcaucgagaacaucaagcacgagcacaaguccaccuggcacuacgacgaggacaaccccuacaagacgugggccuaccacgggagcuacgaggugaagccguccggcagcgccagcuccauggucaacgggguggugaagcugcugaccaagcccugggacgucauccccauggugacccagaucgcgaugaccgacacgacccccuucggccagcagcggguguucaaggagaaggucgacacccgcaccccgaaggccaagcgggggacggcccagaucauggaggugaccgcccgcuggcucuggggcuuccugagccggaacaagaagccccgcaucugcacccgggaggaguucacccgcaaggugcgguccaacgccgcgaucggcgccgucuucguggacgagaaccaguggaacagcgccaaggaggccguggaggacgagcgcuucugggaccugguccaccgggagcgcgagcuccacaagcaggggaagugcgcgacgugcguguacaacaugaugggcaagcgggagaagaagcugggggaguucggcaaggccaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgcggacgacaccgccggcugggacacccgcaucaccgaggacgaccuccagaacgaggccaagaucacggacaucauggagccggagcacgcccugcuggccaccagcaucuucaagcucaccuaccagaacaaggucgugcgcgugcagcggcccgcgcgcaacgggaccgucauggacgugaucucccggcgcgaccagcggggcagcggccaggugggcacguacggccugaacaccuucaccaacauggaggcccagcugauccgccagauggaguccgaggggaucuucagccccuccgagcucgagacccccaaccuggccgagcggguccuggacuggcucgagaagcacggcguggagcgccugaagcggauggccaucagcggggacgacugcguggucaagccgaucgacgaccgcuucgccacggcgcuguccgcccucaacgacaugggcaaggugcggaaggacaucccccagugggagcccagcaagggguggaacgacuggcagcagguccccuucugcagccaccacuuccaccagcugaucaugaaggacggccgcgagaucgucgugccgugccggaaccaggacgagcuggugggccgcgcccgggucucccagggggccggcuggagccuccgcgagaccgccugccuggggaaguccuacgcgcagauguggcagcugauguacuuccaccggcgcgaccuccggcuggccgccaacgccaucugcagcgcggugcccguggacuggguccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccucgggaagcgggaggaccaguggugcggcagccugaucggccugacggcccgcgccaccugggccaccaacauccagguggcgaucaaccaggugcggcgccucaucgggaacgagaacuaccuggacuacaugaccuccaugaagcgguucaagaacgacagcgaccccgagggcgcccugugguga

SEQ ID NO: 8761 - RNA, 9879 nt, Artificial Sequence
  derived and/or modified CDS sequence (opt1) from DENV-1__EU482487__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgccaagaacgagaccuggaagcuggcgcgggccagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgcgaacgccagcgaccgcauggggaugggcaccaccuaccuggcccugauggccacguucaagaugcggccgauguucgccgucggccuccuguuccgccggcugaccucccgcgaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcuccccgugcugcugggcagccucgggugcaagccgcugaccauguuccugaucgccgagaacaagaucuggggccggcgcuccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgggacgacacccugaccauccuccugaaggccacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgcggugcucauguaccaggggaagcgccuggagcccagcugggccuccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgcgaggggaagaucgugggccuguacggcaacgggguggucaccaccagcggcacguacgugagcgccaucgcccaggccaaggcgucccaggaggggccgcuccccgagaucgaggacgagguguuccggaagcgcaaccugaccaucauggaccugcaccccggcagcgggaagacccggcgcuaccucccggccaucguccgggaggccaucaagcgcaagcugcgcacccugauccucgcccccacgcgggugguggccuccgagauggcggaggcccugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugacggcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgcgaacuuccgcgccgaccgggucaucgacccgcgccggugccugaagcccgugauccugaaggacgggcccgagcgcgugauccucgccggccccaugccggucaccguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgccauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucgggcuccuguucaugauccugaccgucgccgcgaacgagaugggccuccuggagaccaccaagaaggaccuggggaucggccacgccgccguggagaaccaccaccacgccgccaugcucgacguggaccugcaccccgcguccgccuggacgcuguacgccgucgccaccaccaucaucaccccgaugaugcgccacacgaucgagaacaccaccgccaacaucagccucaccgcgaucgccaaccaggccgccauccugauggggcuggacaagggcuggcccaucuccaagauggacaucggcgugccccuccuggcgcuggggugcuacagccaggugaacccccucacgcugaccgccgccguccugaugcucguggcccacuacgccaucaucggcccggggcugcaggcgaaggccacccgcgaggcccagaagcggaccgccgccggcaucaugaagaaccccacgguggacgggaucgucgcgaucgaccuggaccccgugguguacgacgccaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgucagcauggcgaacaucuuccggggguccuaccuggccggcgccggccuggccuucagccucaugaagucccucgggggcgggcgccgggggaccggggcgcagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgccgugucccgcggcaccgccaagcuccggugguucgucgagcgcaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggcgaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgccgugaacaugacgucccgcaugcugcucaaccgcuucaccauggcccaccggaagcccaccuacgagcgcgacgucgaccugggggccggcacccggcacguggccguggagcccgaggucgcgaaccuggacaucaucggccagcgcaucgagaacaucaagcacgagcacaagagcacguggcacuacgacgaggacaaccccuacaagaccugggccuaccacggguccuacgaggugaagccgagcggcuccgccagcagcauggugaacggggucgugaagcuccugaccaagcccugggacgucauccccauggugacccagaucgccaugacggacaccacccccuucggccagcagcggguguucaaggagaaggucgacacccgcacgccgaaggccaagcgggggaccgcgcagaucauggaggugaccgccaaguggcuguggggcuuccucucccgcaacaagaagccccggaucugcacccgcgaggaguucacgcggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcgcgcaucaccgacaucauggagccggagcacgcccuccuggccaaguccaucuucaagcugaccuaccagaacaaggucgugcgcgugcagcggcccgccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgcggagcgcguccuggacuggcugaagaaguacggcguggagcggcucaagcgcauggccaucuccggggacgacugcguggucaagccgaucgacgaccgguucgccacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcgcgcgucagccagggggccggcuggagccugcgggagaccgccugccucgggaaguccuacgcccagauguggcagcugauguacuuccaccgccgggaccugcgccucgcggccaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccuggggaagcgcgaggaccaguggugcggcagccucaucggccugaccgcgcgggccaccugggccaccaacauccaggucgccaucaaccaggugcgccggcugaucgggaacgagaacuaccucgacuacaugaccuccaugaagcgcuucaagaacgagggcgaccccgagggggcccugugguga

SEQ ID NO: 8762 - RNA, 9879 nt, Artificial Sequence
  derived and/or modified CDS sequence (opt1) from DENV-1__EU482488__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacaccgccugggacuucgggagcaucggcggcguguucacguccgucgggaagcuggugcaccagaucuucggcaccgccuacggggugcuguucagcggcgucuccuggaccaugaagaucgggaucggcgugcugcugaccuggcucggccugaacagccgcuccacgagccuguccaugaccugcaucgccguggggcucgucacccuguaccugggcgugauggugcaggccgacagcgggugcgucaucaacuggaagggccgggagcucaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccuggagaacaucauguggaagcagaucagcaacgagcucaaccacauccugcuggagaacgacaugaagcucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccucugguccaacggcgugcuggagagcgagaugaucauccccaagaucuacgggggcccgaucucccagcacaacuaccgccccggguacuucacgcagaccgccggccccuggcaccuggggaagcucgagcuggacuucgaccugugcgagggcaccaccguggucguggacgagcacugcggcaaccgggggccgagccuccgcacgaccaccgugaccggcaagaucauccacgaguggugcugccgguccugcacgcugccgccccugcgcuucaagggggaggacggcugcugguacgggauggagauccggcccgucaaggagaaggaggagaaccucgucaagagcauggugagcgccggcuccggcgaggucgacagcuucucccuggggcugcucugcaucagcaucaugaucgaggaggugaugcgcucccgguggagccgcaagaugcugaugaccggcacccuggccguguucuuccuccugaucauggggcagcugaccuggaacgaccucauccggcugugcaucauggucggcgcgaacgccuccgaccgcauggggaugggcacgaccuaccuggcccucauggccaccuucaagaugcgcccgauguucgccgugggccugcuguuccggcgccucaccagccgggaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucauccgcacgaccuucagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgcgacgacacccucaccauccugcugaaggccacccuccuggccgugagcggcguguacccgcuguccauccccgccacccucuucgucugguacuucuggcagaagaagaagcagcggagcggggugcugugggacacgcccagcccgcccgagguggagcgcgccguccuggacgacggcaucuaccggaucaugcagcgcggccugcucgggcggagccaggugggcgugggggucuuccaggagaacguguuccacaccauguggcacgugacccgcggcgcgguccugauguaccaggggaagcggcuggagcccuccugggccagcgugaagaaggaccucaucuccuacggcggcggguggcgccugcagggcagcuggaacaccggggaggaggugcaggucaucgccguggagcccggcaagaaccccaagaacgugcagacggcccccgggaccuucaagaccuccgagggcgaggucggcgccaucgcgcuggacuucaagcccgggaccagcggcagccccaucgugaaccgggaggggaagaucgugggccucuacggcaacggggucgugacgaccuccggcaccuacgugagcgccaucgcccaggccaaggcgucccaggaggggccccugccggagaucgaggacgaggucuuccgcaagcggaaccugaccaucauggaccuccaccccggcagcgggaagacgcgccgguaccugcccgccaucgugcgcgaggccaucaagcggcgccugcgcacccucauccuggccccgacccggguggucgccuccgagauggcggaggcccugaagggcaugcccauccgcuaccagaccacggccgucaagagcgagcacaccggcaaggagaucguggaccucaugugccacgccaccuucaccaugcggcugcugucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccugaagccggugauccucaaggacgggcccgagcgcgucauccuggccggccccaugcccgugaccgucgccuccgccgcgcagcggcgcgggcggaucggccgcaaccacaacaaggagggcgaccaguacaucuacauggggcagccgcugaacaacgacgaggaccacgcccacuggacggaggccaagaugcuccuggacaacaucaacacccccgagggcaucauccccgcccuguucgagcccgagcgcgagaaguccgccgcgaucgacggggaguaccggcuccgcggcgaggcccggaagaccuucguggagcugaugcgccgcggggaccugccgguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgcggccggccgccggagcgucuccggggaccucauccuggagaucggcaagcugccccagcaccucacccagcgcgcccagaacgcccuggacaaccuggugaugcuccacaacagcgagcagggcgggcgggcguaccgccacgccauggaggagcugccggacaccaucgagacccugaugcuccuggcccugaucgccgugcucacgggcggggucacccuguucuuccuguccggccgggggcucggcaagaccagcaucggccugcugugcgugauggccuccagcgugcuccuguggauggcguccgucgagccccacuggaucgccgccagcaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucacccccaugaugcgccacaccaucgagaacaccacggccaacaucagccugaccgccaucgcgaaccaggccgccauccugauggggcucgacaagggcuggccgaucuccaagauggacaucggcgucccccugcuggcccucgggugcuacagccaggugaacccccugacccugaccgcggccgugcucaugcuggucgcccacuacgccaucaucggccccgggcugcaggccaaggcgacgcgcgaggcccagaagcggaccgccgccggcaucaugaagaacccgaccguggacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggaggggucccccggcaaguucuggaacaccaccaucgccgugagcauggccaacaucuuccgggggagcuaccuggcgggcgccggccucgccuucucccugaugaagucccucgggggcgggcgccgggggacgggggcccagggcgagacccucggcgagaaguggaagcgccagcugaaccagcuguccaagagcgaguucaacaccuacaagcgguccgggaucauggaggucgaccgcagcgaggcgaaggagggccucaagcgcggggagaccacgaagcacgccgugucccgcggcaccgccaagcugcggugguucguggagcgcaaccuggucaagccggaggggaaggugaucgaccugggcugcggccgcggcggguggagcuacuacugcgccgggcucaagaaggugaccgaggucaagggguacaccaagggcggccccggccacgaggagcccauccccauggccacguacggguggaaccuggugaagcugcacuccggcaaggacguguucuucaucccgcccgagaagugcgacacccuccugugcgacaucggggagagcucccccaaccccaccaucgaggagggccgcacccugcggguccucaagaugguggagccguggcugcgcgggaaccaguucugcaucaagauccugaaccccuacaugcccagcguggucgagacgcucgagcagaugcagcggaagcacggcggcaugcuggugcgcaacccccugucccggaacagcacccacgagauguacuggguguccugcgggaccggcaacaucgucagcgcggugaacaugaccucccgcaugcuccugaaccgcuucaccauggcccaccggaagccgacguacgagcgcgacguggaccugggggccggcacccggcacgucgccguggagcccgagguggccaaccucgacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcugacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcucuggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagcccgagcacgcgcugcuggccaaguccaucuucaagcucacguaccagaacaaggugguccgcgugcagcgcccggccaagaacgggaccgugauggacgucaucagccggcgcgaccagcggggcuccggccaggugggcaccuacggccugaacaccuucacgaacauggaggcccagcugauccgccagauggagagcgaggggaucuucucccccagcgagcucgagacccccaaccuggccggccgggugcuggacuggcucgagaagcacggggucgagcgccugaagcggauggcgaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcugguggggcgcgcccgggugucccagggcgcgggguggagccuccgcgagacggccugccugggcaaguccuacgcccagauguggcagcugauguacuuccaccggcgcgaccuccggcuggccgcgaacgccaucugcagcgccgucccgguggacugggugcccaccucccgcaccaccuggagcauccacgcccaccaccaguggaugacgaccgaggacaugcuguccgucuggaaccggguguggaucgaggagaaccccuggauggaggacaagacccacgugagcuccugggaggacguccccuaccucgggaagcgcgaggaccaguggugcggcagccugaucggccugaccgcccgcgcgacgugggccaccaacauccagguggccaucaaccaggugcggcgccuccuggggaacgagaacuaccuggacuacaugaccuccaugaagcgguucaagaacgagagcgacccggagggcgcccucugguga

SEQ ID NO: 8763 - RNA, 9879 nt, Artificial Sequence
  derived and/or modified CDS sequence (opt1) from DENV-1__EU482489__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucacccugaucgcccuguuccucgcccacgcgaucggcaccagcaucacccagaaggggaucaucuucauccugcugaugcucgugacgcccuccauggccaugcggugcgugggcaucggcagccgcgacuucgucgaggggcuguccggcgccaccuggguggacgugguccuggagcacgggagcugcgugaccaccauggccaaggacaagcccacgcucgacaucgagcugcugaagaccgaggugaccaaccccgccguccuccggaagcugugcaucgaggcgaagaucuccaacaccacgaccgacagccgcugcccgacccagggcgaggccacccugguggaggagcaggacgccaacuucgugugccggcgcacguucgucgaccggggcugggggaacggcugcggccuguucggcaaggggucccugaucacgugcgccaaguucaagugcgugaccaagcuggagggcaagaucgugcaguacgagaaccucaaguacagcgucaucgugaccgugcacacgggcgaccagcaccaggucgggaacgaguccaccgagcacggcaccaccgccaccaucacgccccaggcgcccaccaccgagauccagcugaccgacuacggggcccugacgcucgacugcagcccccgcaccggccuggacuucaacgagauggugcugcucaccaugaaggagaaguccuggcugguccacaagcagugguuccuggaccucccccugcccuggaccagcggggccagcacgucccaggagaccuggaaccggcaggaccugcucgugaccuucaagaccgcccacgccaagaagcaggagguggucgugcugggcagccaggagggcgcgaugcacacggcccugaccggggccaccgagauccagaccuccggcacgaccaccaucuucgccgggcaccucaagugccgccugaagauggacaagcugacccucaagggcaugagcuacgugaugugcacgggguccuucaagcuggagaaggagcuggccgagacccagcacggcaccguccuggugcagaucaaguacgagggcaccgacgcgcccugcaagauccccuucagcacgcaggacgagaagggggugacccagaacggccggcucaucaccgccaacccgaucgucaccgacaaggagaagcccgugaacaucgaggccgagccgcccuucggggaguccuacaucgugaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcgucuucaccagcguggggaagcuggugcaccagaucuucggcaccgccuacgggguccuguucuccggcgugagcuggacgaugaagaucgggaucggcgugcuccugaccuggcugggccucaacucccgcagcaccucccugagcaugaccugcaucgccgucgggcuggugacgcucuaccugggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacgguggucgugggggacguggccggcauccuggcgcaggggaagaagaugauccggccccagcccauggaguacaaguacagcuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggugugcgaccaccgccugauguccgcggccaucaaggacagcaaggccguccacgccgacaugggcuacuggaucgaguccgagaagaacgagaccuggaagcucgcccgggcgagcuucaucgaggugaagacgugcaucuggcccaagucccacacccuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgucgugguggacgagcacugcggcaaccgggggccgucccugcgcaccaccacggucaccggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacgcucgccgucuucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgugggccuccucuuccgccggcugaccucccgcgagguccugcuccugaccaucgggcugagccucguggccuccguggagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacuacgccuggaagacgauggccaugguccugagcaucgugucccuguucccccucugccugagcaccaccucccagaagaccacguggcugcccguccuccugggcagccuggggugcaagccgcucaccauguuccugaucgcggagaacaagaucuggggccggcgcuccuggccccugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacgcugcuggccguguccggcgucuacccgcucagcauccccgccacccuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacgcggggcgccgugcugauguaccaggggaagcgccucgagcccagcugggcguccgugaagaaggaccugaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucgugcgggaggccaucaagcgcaagcuccgcacccugauccuggcccccacgcgggucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccucaagcccgucauccugaaggacgggcccgagcgcgugauccuggccggccccaugccggugaccgucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgcgaggcgcagaagcggaccgccgccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgucagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggugucccgcggcaccgccaagcugcggugguucgucgagcgcaaccuggugaagcccgaggggaaggugaucgaccucggcugcggccgcggcggguggagcuacuacugcgccgggcugaagaaggucacggaggugaagggguacaccaagggcgggcccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccgcacccuccgggugcugaagaugguggagcccuggcugcgcgggaaccaguucugcaucaagauccucaaccccuacaugcccagcgucguggagacccuggagcagaugcagcggaagcacggcggcaugcuggugcgcaacccgcucucccggaacagcacccacgagauguacugggucuccugcgggaccggcaacaucgugagcgccgugaacaugacgucccgcaugcugcugaaccgcuucaccauggcgcaccggaagcccaccuacgagcgcgacgucgaccucggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcucaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcucauccggcagauggagagcgaggggaucuucucccccagcgagcuggagacccccaaccuggccgagcgcguccucgacuggcuggagaaguacggcguggagcggcugaagcgcauggccaucuccggggacgacugcguggucaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagaccgcgugccuggggaaguccuacgcccagauguggcagcucauguacuuccaccgccgggaccugcgccuggccgccaacgcgaucugcagcgccgugcccguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccuggggaagcgcgaggaccaguggugcggcagccugaucggccucaccgcccgggccaccugggcgaccaacauccaggucgccaucaaccaggugcgccggcugaucgggaacgagaacuaccuggacuacaugaccuccaugaagcgcuucaagaacgagagcgaccccgagggcgcccucugguga

SEQ ID NO: 8764 - RNA, 9879 nt, Artificial Sequence
  derived and/or modified CDS sequence (opt1) from DENV-1__EU482490__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucacgaucggcgccggcgagaaggcgcugaagcucagcugguucaagaagggguccagcaucggcaagauguucgaggccaccgcccgcggggcccggcgcauggccauccugggcgacaccgcgugggacuucggguccaucggcggcguguucaccagcguggggaagcugguccaccagaucuucggcacggccuacggggugcuguucuccggcgugagcuggaccaugaagaucgggaucggcguccugcugaccuggcucggccugaacucccgcagcaccucccugagcaugacgugcaucgccguggggcucgugacccuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacgcgccuggagaacaucauguggaagcagaucuccaacgagcucaaccacauccugcuggagaacgacaugaaguucaccgucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacagcuacacccaggucugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaucuggcccaagucccacacccuguggagcaacggcguccucgaguccgagaugaucauccccaagaucuacgggggcccgaucagccagcacaacuaccgccccggguacuucacccagacggccggccccuggcaccuggggaagcuggagcucgacuucgaccugugcgagggcaccaccgugguggucgacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugacgggcacccuggccguguucuuccugcucaucauggggcagcugaccuggaacgaccugauccgccucugcaucauggugggcgccaacgcgagcgaccgcauggggaugggcaccacguaccuggcccugauggccaccuucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugacggacuuccagucccaccagcucugggccacccugcugagccucaccuucaucaagaccacguucucccugcacuacgccuggaagaccauggccauggugcugagcaucgucucccucuucccccugugccugagcaccaccucccagaagacgaccuggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugacgauccuccugaaggcgacccugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacacgauguggcacgugacccggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggacguucaagacccccgagggcgaggugggcgccaucgcccuggacuucaagcccgggaccagcggcucccccaucgucaaccgcgaggggaagaucgugggccuguacggcaacgggguggucaccacgagcggcaccuacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacgcugauccucgcccccacccgggugguggccuccgagauggccgaggcgcugaagggcaugcccauccgcuaccagaccaccgccgucaagagcgagcacacgggcaaggagaucguggaccugaugugccacgccaccuucaccaugcggcuccugucccccgugcgcgucccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucaccgacuuccccggcaagacggugugguucgugcccuccaucaagagcggcaacgacaucgccaacugccugcggaagaacgggaagcgcgucauccagcucucccggaagaccuucgacaccgaguaccagaagaccaagaacaacgacugggacuacguggugacgaccgacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacgcccgagggcaucauccccgcccuguucgagccggagcgcgagaaguccgccgccaucgacggggaguaccggcugcgcggcgaggcgcggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacgcagcgcgcccagaacgcccucgacaaccuggucaugcugcacaacagcgagcagggcgggcgggccuaccgccacgcgauggaggagcuccccgacaccaucgagacccugaugcugcucgcccugaucgccgugcugaccggcggggugacccucuucuuccuguccggccgggggcugggcaagacgagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccacgaagaaggaccuggggaucggccacguggcgguggagaaccaccaccacgccgccaugcucgacgucgaccugcaccccgccuccgccuggacccuguacgcgguggccaccaccaucaucacgccgaugaugcgccacaccaucgagaacaccaccgccaacaucagccucacggccaucgccaaccaggcggccauccugauggggcuggacaagggcuggcccaucuccaagauggacaucggcgugccccuccuggcccuggggugcuacagccaggucaacccccucacccugaccgccgcggugcugaugcucguggcccacuacgccaucaucggcccggggcugcaggccaaggccacccgcgaggcgcagaagcggacggccgccggcaucaugaagaaccccaccgucgacgggaucguggccaucgaccuggaccccguggucuacgacgccaaguucgagaagcagcucggccagaucaugcugcugauccucugcaccucccagauccugcugaugcgcaccacgugggcgcucugcgagagcaucacccuggccaccggcccccugaccacgcucugggagggguccccgggcaaguucuggaacaccaccaucgccgugagcauggccaacaucuuccggggguccuaccuggccggcgcgggccuggccuucagccucaugaagucccucgggggcgggcgccgggggaccggggcccagggcgagacgcugggcgagaaguggaagcgccagcucaaccagcuguccaagagcgaguucaacaccuacaagcgguccgggaucauggagguggaccgcagcgaggccaaggagggccugaagcgcggggagaccaccaagcacgcggucucccgcggcacggccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggccaccuacggguggaaccucgucaagcugcacuccggcaaggacguguucuucaucccgcccgagaagugcgacacgcugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggacgggcaacaucgugagcgccgucaacaugaccucccgcaugcugcucaaccgcuucaccauggcgcaccggaagcccaccuacgagcgcgacguggaccugggggccggcacgcggcacguggccgucgagcccgagguggccaaccuggacaucaucggccagcgcaucgagaacaucaagcacgagcacaagagcaccuggcacuacgacgaggacaaccccuacaagaccugggccuaccacggguccuacgaggugaagccgagcggcuccgcgagcagcauggucaacgggguggucaagcuccugaccaagcccugggacgugauccccauggugacgcagaucgccaugaccgacaccacccccuucggccagcagcgggucuucaaggagaagguggacacgcgcaccccgaaggccaagcgggggaccgcccagaucauggaggugaccgccaaguggcuguggggcuuccucucccgcaacaagaagccccggaucugcacgcgcgaggaguucacccggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacgcggaucaccgaggacgaccugcagaacgaggcccgcaucaccgacaucauggagccggagcacgcccuccuggcgaaguccaucuucaagcugaccuaccagaacaagguggugcgcguccagcggcccgccaagaacgggacggugauggacgugaucagccgccgggaccagcgcggcuccgggcaggucggcaccuacggccucaacaccuucaccaacauggaggcccagcugauccggcagauggagagcgaggggaucuucucccccagcgagcuggagacgcccaaccucgccgagcgcgugcuggacuggcuggagaaguacggcguggagcggcucaagcgcauggccaucuccggggacgacugcgucgugaagccgaucgacgaccgguucgcgaccgcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugacguccaugaagcgcuucaagaacgagagcgaccccgagggcgcccugugguga

SEQ ID NO: 8765 - RNA, 9879 nt, Artificial Sequence
  derived and/or modified CDS sequence (opt1) from DENV-1__EU482491__SS-prME
agcgugaccaugcugcucaugcugaugcccaccgcccuggccuuccaccucacgacccggggcggggagccccacaugaucgugagcaagcaggagcggggcaagagccugcuguucaagaccuccgcgggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcacccagaucggcgagcaccggcgcgacaagcggagcguggcccuggcgccccacgugggccucgggcuggagacgcgcaccgagaccuggauguccagcgagggcgccuggaagcagauccagcgggucgagaccugggcccugcgccaccccggguucacggugaucgcccucuuccuggcgcacgccaucggcaccuccaucacccagaaggggaucaucuucauccugcucaugcuggccacccccagcauggccaugcggugcgugggcaucggcucccgcgacuucgucgaggggcugagcggcgccacguggguggacgugguccucgagcacggguccugcgugaccaccauggcgaaggacaagcccacccuggacaucgagcugcucaagacggaggugaccaaccccgccguccugcggaagcugugcaucgaggccaagaucagcaacaccaccacggacucccgcugcccgacccagggcgaggccacccucguggaggagcaggacgccaacuucgugugccggcgcaccuucgucgaccggggcugggggaacggcugcgggcuguucggcaaggggagccugaucacgugcgcgaaguucaagugcgugaccaagcucgagggcaagaucgugcaguacgagaaccugaaguacuccgucaucgugaccgugcacaccggcgaccagcaccaggucgggaacgagagcacggagcacggcaccaucgccaccaucacgccccaggcccccuccaccgagauccagcugacggacuacggggcccucacccuggacugcagcccccgcaccggccuggacuucaacgagauggugcuccugaccaugaaggagaaguccuggcugguccacaagcagugguuccucgaccugccgcugcccuggacgagcggggccagcaccucccaggagaccuggaaccggcaggaccuccuggugaccuucaagacggcgcacgccaagaagcaggagguggucgugcugggcagccaggagggcgccaugcacaccgcccucaccggggccaccgagauccagacguccggcaccaccaccaucuucgcggggcaccugaagugccgccugaagauggacaagcucacgcugcggggcaugagcuacgugaugugcaccggguccuucaagcuggagaaggaggucgccgagacccagcacggcaccgugcucgugcagaucaaguacgagggcacggacgcccccugcaagauccccuucagcacccaggacgagaagggggucacccagaacggccgccugaucaccgccaacccgaucgugacggacaaggagaagcccgugaacaucgaggcggagccgcccuucggggaguccuacaucgucaucggcgccggcgagaaggcccugaagcugagcugguucaagaagggguccagcaucggcaagauguucgaggccaccgcccgcggggcccgccgcauggccauccucggcgacaccgccugggacuucggguccaucggcggcguguucaccagcguggggaagcugguccaccagaucuucggcacggccuacggggugcuguucuccggcgugagcuggaccaugaagaucgggaucggcguccuccugaccuggcugggccucaacucccggagcaccucccugagcaugacgugcaucgccguggggcuggugacccucuaccugggcgucauggugcaggcggacuccgggugcgugaucaacuggaagggccgcgagcugaagugcgggagcggcaucuucgucaccaacgaggugcacaccuggacggagcaguacaaguuccaggccgacagcccgaagcggcucuccgccgccaucggcaaggccugggaggagggggugugcggcauccgcagcgcgacccggcuggagaacaucauguggaagcagaucuccaacgagcugaaccacauccuccuggagaacgacaugaagcugaccgucguggugggggacgucgccggcauccucgcccaggggaagaagaugauccgcccccagcccauggaguacaaguacagcuggaagaucuggggcaaggccaagaucaucggcgcggacgugcagaacaccaccuucaucaucgacgggcccaacacgccggagugccccgacgaccagcgggccuggaacaucugggagguggaggacuacggcuucgggaucuucaccaccaacaucuggcugaagcugcgcgacuccuacacccaggucugcgaccaccggcucaugagcgccgccaucaaggacuccaaggccgugcacgcggacaugggcuacuggaucgagagcgagaagaacgagacguggaagcuggcccgcgccuccuucaucgaggugaagaccugcaucuggcccaagagccacacccugugguccaacggcguccucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgugguggucgacgagcacugcggcaaccgcgggccgagccugcggaccacgaccgugaccggcaagaucauccacgaguggugcugccgcuccugcacccugccgccccuccgguucaagggggaggacggcugcugguacgggauggagauccgccccgugaaggagaaggaggagaaccuggucaagagcaugguguccgccggcagcggcgagguggacagcuucucccucgggcugcugugcaucagcaucaugaucgaggaggucaugcggucccgcuggagccggaagaugcucaugacgggcacccuggcgguguucuuccugcucaucauggggcagcugaccuggaacgaccugauccgccucugcaucauggugggcgccaacgccuccgaccgcauggggaugggcaccacguaccuggcccugauggccaccuucaagaugcggccgauguucgcggucggccuccuguuccgccggcugaccagccgcgaggugcuccugcugaccaucgggcucucccugguggccagcgucgagcugcccaacucccucgaggagcugggcgacgggcuggccaugggcaucaugauccucaagcugcugacggacuuccagagccaccagcucugggccacccugcugucccucaccuucauccggaccacguucagccugcacuacgcguggaagaccauggccauggugcuguccaucgucagccucuucccccugugccuguccaccaccagccagaagacgaccuggcuccccgugcugcugggcucccucgggugcaagccgcugaccauguuccugaucgccgagaacaagaucuggggccgcaagagcuggccccucaacgaggggaucauggccgugggcaucgucuccauccugcugagcagccuccugaagaacgacgugccccuggccgggccccucaucgcgggcggcaugcugaucgccugcuacgugaucuccgggagcuccgccgaccugagccucgagaaggccgccgaggucuccugggaggaggaggcggagcacagcggcgccucccacaacauccugguggaggugcaggacgacgggaccaugaagaucaaggacgaggagcgggacgacacgcugaccauccuccugaaggccacccugcucgccgucagcggcguguacccgcuguccauccccgccacccuguucgugugguacuucuggcagaagaagaagcagcgcagcgggguccucugggacacccccagcccgcccgagguggagcgggcggugcuggacgacggcaucuaccgcaucaugcagcggggccugcuggggcgcagccaggucggcguggggguguuccaggagaacgucuuccacacgauguggcacgugacccggggcgccgugcucauguaccaggggaagcgccuggagcccuccugggccagcgucaagaaggaccugaucuccuacggcggcggguggcggcuccagggcagcuggaacaccggggaggagguccaggugaucgccgucgagcccggcaagaaccccaagaacgugcagaccgcccccgggacguucaagaccuccgagggcgaggugggcgcgaucgcccuggacuucaagcccgggaccagcggcucccccaucgucaaccgcgaggggaagaucgugggccuguacggcaacgggguggucaccacgagcggcaccuacgugagcgccaucgcccaggcgaaggccucccaggaggggccccucccggagaucgaggacgagguguuccggaagcgcaaccugaccaucauggaccugcaccccggcagcgggaagacccggcgcuaccuccccgccaucguccgggaggccaucaagcgccgccugcggacgcugauccucgccccgacccgcgugguggcguccgagauggccgaggcccugaagggcaugcccauccgguaccagaccaccgccgucaagagcgagcacacgggcaaggagaucguggaccugaugugccacgccaccuucaccaugcgccuccugucccccgugcggguccccaacuacaacaugaucaucauggacgaggcgcacuucaccgacccgagcuccaucgccgcccgcggguacaucagcacgcgggugggcaugggggaggccgccgcgaucuucaugaccgccacgccgcccggcuccguggaggccuucccccagagcaacgccgucauccaggacgaggagcgcgacaucccggagcgguccuggaacagcggguacgaguggaucaccgacuuccccggcaagacggugugguucgugcccuccaucaagagcggcaacgacaucgcgaacugccugcgcaagaacgggaagcgggucauccagcucucccgcaagaccuucgacaccgaguaccagaagaccaagaacaacgacugggacuacguggugacgaccgacaucagcgagaugggcgccaacuuccgggccgaccgcgucaucgacccccggcgcugccugaagccggugauccugaaggacgggcccgagcgggugauccucgccggccccaugcccgucaccguggccuccgcggcccagcgccgggggcgcaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgggagaaguccgcggccaucgacggggaguaccgccugcggggcgaggcccgcaagaccuucgucgagcucaugcggcgcggggaccugccgguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcgcugcgcgaguucaaggaguucgccgccggccggcgcagcguguccggggaccugauccucgagaucggcaagcugccccagcaccugacgcagcgggcccagaacgcgcucgacaaccuggucaugcugcacaacagcgagcagggcgggcgcgccuaccggcacgccauggaggagcucccggacaccaucgagacccugaugcugcucgcccugaucgccgugcugaccggcggggugacccuguucuuccuguccggccgcgggcugggcaagaccagcaucggccuccugugcgucauggcguccagcgugcugcucuggauggccuccguggagccccacuggaucgccgccagcaucauccuggaguucuuccugaugguccuccugauccccgagcccgaccggcagcgcaccccgcaggacaaccagcuggccuacguggugaucgggcuccuguucaugauccugaccgucgcggccaacgagaugggccuccuggagaccacgaagaaggaccuggggaucggccacguggccguggagaaccaccaccacgccgccaugcucgacgucgaccugcaccccgcguccgccuggacccuguacgccguggccaccaccaucaucacgcccaugaugcgccacaccaucgagaacaccaccgccaacaucagccucacggcgaucgccaaccaggccgccauccugauggggcuggacaagggcuggccgaucuccaagauggacaucggcgugccccuccuggcgcuggggugcuacagccaggucaacccccucacccugaccgccgccgugcugaugcucguggcccacuacgccaucaucggccccgggcugcaggcgaaggccacccgggaggcccagaagcgcacggccgccggcaucaugaagaacccgaccgucgacgggaucguggcgaucgaccuggaccccguggucuacgacgccaaguucgagaagcagcucggccagaucaugcugcugauccucugcaccucccagauccugcugaugcggaccacgugggcccucugcgagagcaucacccuggccaccggcccccugaccacgcucugggaggggucccccggcaaguucuggaacaccaccaucgccgugagcauggcgaacaucuuccgcggguccuaccuggccggcgccggccuggccuucagccucaugaagucccucgggggcgggcggcgcgggaccggggcgcagggcgagacgcugggcgagaaguggaagcggcagcucaaccagcuguccaagagcgaguucaacaccuacaagcgcuccgggaucauggagguggaccggagcgaggccaaggagggccugaagcgcggggagaccaccaagcacgccgucucccggggcacggccaagcuccgcugguucguggagcggaaccuggugaagccggaggggaaggucaucgaccugggcugcggccgcgggggcuggagcuacuacugcgccgggcugaagaaggugaccgaggugaagggcuacaccaagggcgggcccggccacgaggagcccauccccauggcgaccuacggguggaaccucgucaagcugcacuccggcaaggacguguucuucaucccgcccgagaagugcgacacgcugcucugcgacaucggggagagcucccccaaccccaccaucgaggagggccggacccugcgcgugcugaagauggucgagccguggcuccgggggaaccaguucugcaucaagauccugaaccccuacaugcccagcgugguggagacccuggagcagaugcagcgcaagcacggcggcaugcucguccggaacccccugucccgcaacagcacgcacgagauguacuggguguccugcgggaccggcaacaucgugagcgccgucaacaugaccucccgcaugcugcucaaccgguucaccauggcccaccgcaagccgaccuacgagcgggacguggaccugggggccggcacgcgccacguggccgucgagcccgagguggcgaaccuggacaucaucggccagcggaucgagaacaucaagcacgagcacaagagcaccuggcacuacgacgaggacaaccccuacaagaccugggccuaccacggguccuacgaggugaagcccagcggcuccgccagcagcauggucaacgggguggucaagcuccugaccaagccgugggacgugauccccauggugacgcagaucgccaugaccgacaccacccccuucggccagcagcgcgucuucaaggagaagguggacacgcggacccccaaggccaagcgcgggaccgcgcagaucauggaggugaccgccaaguggcuguggggcuuccucucccggaacaagaagccgcgcaucugcacgcgggaggaguucacccgcaagguccggagcaacgccgccaucggcgcgguguucguggacgagaaccaguggaacuccgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacgcgcaucaccgaggacgaccugcagaacgaggcgaagaucaccgacaucauggagcccgagcacgcccuccuggccaaguccaucuucaagcugaccuaccagaacaagguggugcgcguccagcggccggccaagaacgggacggugauggacgugaucagccgccgggaccagcgcggcuccgggcaggucggcaccuacggccucaacaccuucaccaacauggaggcccagcugauccggcagauggagagcgaggggaucuucucccccagcgagcuggagacgcccaaccucgcgggccgcgugcuggacuggcuggagaagcacgggguggagcggcucaagcgcauggccaucuccggcgacgacugcgucgugaagcccaucgacgaccgguucgccaccgcccugaccgcccugaacgacauggggaaggugcgcaaggacaucccgcagugggagcccagcaagggcuggaacgacuggcagcagguccccuucugcucccaccacuuccaccagcucaucaugaaggacggccgggagaucguggugcccugccgcaaccaggacgagcuggucgggcgggcgcgcgugagccagggcgccggguggagccugcgggagaccgccugccucggcaaguccuacgcccagauguggcagcugauguacuuccaccgccgggaccugcgccucgcggccaacgccaucugcagcgccgugccggucgacugggugcccacgucccggaccaccuggagcauccacgcccaccaccaguggaugaccacggaggacaugcuguccguguggaaccgcgucuggaucgaggagaaccccuggauggaggacaagacccacgugagcuccuggggcgacgugcccuaccugggcaagcgcgaggaccaguggugcggcagccucaucgggcugaccgcgcgggccaccugggccacgaacauccaggucgccaucaaccaggugcgccggcugcucggcaacgagaacuaccuggacuacaugaccuccaugaagcgcuucaagaacgagagcgacccggagggggcccugugguga

SEQ ID NO: 8766 - RNA, 9879 nt, Artificial Sequence
  derived and/or modified CDS sequence (opt1) from DENV-1__EU482493__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucguggggcagcugaccuggaacgaccucauccgccugugcaucauggucggcgccaacgcgagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccaugguccucagcguggugucccuguucccccugugccucagcaccaccucccagaagaccacguggcugcccguccugcucggcagccuggggugcaagccgcugaccauguuccucaucgcggagaacaagaucuggggccggcgcuccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggccuccguggagccccacuggaucgcggccagcaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgucagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgccgugaacaugacgucccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcguccuggacuggcucgagaaguacggcguggagcggcugaagcgcauggccaucuccggggacgacugcguggucaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggccggcuggagccuccgggagaccgcgugccuggggaaguccuacgcccagauguggcagcugauguacuuccaccgccgggaccuccgccuggccgccaacgcgaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8767 - RNA, 9879 nt, Artificial Sequence
  derived and/or modified CDS sequence (opt1) from DENV-1__EU482494__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaucaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggccacgcccuccauggccaugcggugcgugggcaucggcagccgcgacuucgucgaggggcucuccggcgccaccuggguggacgugguccuggagcacgggagcugcgugaccaccauggccaaggacaagcccacgcuggacaucgagcuccugaagaccgaggugaccaaccccgcgguccugcggaagcucugcaucgaggccaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgcgaccaucacgccccaggcccccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgcgaagaagcaggagguggucgugcucggcagccaggagggcgccaugcacacggcccugaccggggccaccgagauccagaccuccggcacgaccaccaucuucgccgggcaccugaagugccgccucaagauggacaagcugacccugcggggcaugagcuacgugaugugcacgggguccuucaagcucgagaaggaggucgcggagacccagcacggcaccgugcuggugcagaucaaguacgagggcaccgacgcccccugcaagauccccuucagcacgcaggacgagaagggggucacccagaacggccgccugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccacggcccgcggggcccgccgcauggcgauccugggcgacaccgccugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccggagcaccucccugagcaugaccugcaucgccguggggcucgugacgcuguaccugggcgucauggugcaggccgacuccgggugcgugaucaacuggaagggccgcgagcucaagugcgggagcggcaucuucgucaccaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgcgggcauccucgcccaggggaagaagaugauccgcccccagcccauggagcacaaguacagcuggaaguccuggggcaaggccaagaucaucggcgccgacgugcagaacaccaccuucaucaucgacgggcccaacaccccggagugccccgacgaccagcgggcguggaacaucugggagguggaggacuacggcuucgggaucuucacgaccaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagacgugcaucuggcccaagucccacacccuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccgugguggucgacgagcacugcggcaaccgcgggccgucccugcggaccaccacggugaccggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacgcuggccguguucuuccugcucaucauggggcagcugaccuggaacgaccugauccgccucugcaucauggugggcgcgaacgccagcgaccggauggggaugggcaccaccuaccuggcccugauggccacguucaagaugcgcccgauguucgccgucggccuccuguuccggcgccugaccucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcuccccgugcugcugggcagccucgggugcaagccgcugaccauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacgcugcucgccgucuccggcguguacccgcugagcauccccgccacccuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacgcgcggcgcggugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcuccccgagaucgaggacgagguguuccgcaagcggaaccugaccaucauggaccugcaccccggcagcgggaagacccgccgguaccucccggccaucguccgcgaggccaucaagcgcaagcugcggacccugauccucgcccccacgcgcgugguggccuccgagauggcggaggcccugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgcgaacuuccgggccgaccgcgucaucgacccgcggcgcugccugaagcccgugauccugaaggacgggcccgagcgggugauccucgccggccccaugccggucaccguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgccgcgaacgagaugggccuccuggagaccaccaagaaggaccuggggaucggccacguggccguggagaaccaccaccacgccgccaugcucgacgucgaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggucaacccccucacgcugaccgcggccgugcugaugcucguggcccacuacgccaucaucggcccggggcugcaggccaaggcgacccgggaggcccagaagcgcaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacacguacaagcgcuccgggaucauggagguggaccggagcgaggcgaaggagggccugaagcgcggggagaccaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgcggucaacaugacgucccgcaugcugcucaaccgguucaccauggcccaccgcaagcccaccuacgagcgggacguggaccugggggccggcacccgccacguggccgucgagcccgagguggccaaccuggacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcuccugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgaaguggcuguggggcuuccucucccggaacaagaagccccgcaucugcacccgggaggaguucacgcgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucacggaggacgaccugcagaacgaggcccgcaucaccgacaucauggagccggagcacgcgcuccuggccaaguccaucuucaagcugaccuaccagaacaagguggugcggguccagcgccccgccaagaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaaguacggcguggagcgccucaagcggauggcgaucuccggggacgacugcgucgugaagccgaucgacgaccgcuucgccacggcccugaccgcccugaacgacaugggcaaggugcggaaggacaucccccagugggagcccagcaagggguggaacgacuggcagcagguccccuucugcucccaccacuuccaccagcucaucaugaaggacggccgcgagaucguggugccgugccggaaccaggacgagcuggucggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccgugcccgucgacuggauccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgggaggaccaguggugcggcagccucaucggccugaccgcccgcgcgaccugggccaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8768 - RNA, 9879 nt, Artificial Sequence
  derived and/or modified CDS sequence (opt1) from DENV-1__EU482495__SS-prME
uccgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgggccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccgccaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccggcucaagauggacaagcugacccugaagggcauguccuacgugaugugcaccgggcuguucaagcuggagaaggagguggccgagacccagcacggcacgguccuggugcagaucaaguacgagggcaccgacgcgcccugcaagauccccuucagcacccaggacgagaagggggugacccagaacggccgccugaucacggccaacccgaucgucaccgacaaggagaagcccgugaacaucgaggccgagccgcccuucggggaguccuacaucgugaucggcgccggcgagaaggcgcucaagcugagcugguucaagaagggguccagcaucggcaagauguucgaggccaccgcccgcggggcccgccggauggccauccugggcgacaccgcgugggacuucggguccaucggcggcgucuucacgagcguggggaagcucgugcaccagaucuucggcaccgccuacgggguccuguucuccggcgugagcuggaccaugaagaucgggaucggcgugcugcucaccuggcugggccugaacucccgcagcacgucccucagcaugaccugcaucgccgucgggcuggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggcgccagaucuccaacgagcugaaccacauccugcucgagaacgacaugaaguucaccguggucgugggggacguggucggcauccuggcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcuccgggacagcuacacgcaggucugcgaccaccgccugauguccgccgcgaucaaggacagcaaggccgugcacgccgacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggcccgaucagccagcacaacuaccgccccggguacuucacgcagaccgcgggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgugaaggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacccuggccguguucuuccuccugaucauggggcagcugaccuggaacgaccucauccggagcugcaucauggugggcgccaacgccuccgaccgcauggggaugggcacgaccuaccuggcgcugauggccaccuucaagaugcgcccgauguucgccgucggccuccuguuccggcgccugaccagccgggaggugcuccugcugacgaucgggcucucccuggucgccagcguggagcugcccaacucccucgaggagcugggcgacgggcuggccaugggcaucaugauccucaagcugcugaccgacuuccagagcuaccagcucugggcgacccugcugucccucaccuucaucaagacgaccuucagccugcacuacgccuggaagaccauggccauggugcuguccaucgucagccuccugccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgggacgacacccucaccauccugcugaaggccacccuccuggcggucagcggcguguacccgcuguccauccccgccacccucuucgugugguacuucuggcagaagaagaagcagcgcagcgggguccugugggacacgcccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccucuacggcaacgggguggucacgaccagcggcaccuacguguccgccaucgcgcaggccaaggccagccaggaggggccgcugcccgagaucgaggacgagguguuccggaagcgcaaccugaccaucauggaccuccaccccggcuccgggaagacgcggcgcuaccugccggccaucguccgggaggcgaucaagcgcaagcugcggacccucauccuggcccccacccgcgugguggccagcgagauggccgaggcccugaagggcaugcccauccgcuaccagaccacggcggucaaguccgagcacaccggccgggagaucguggaccucaugugccacgccaccuucaccaugcgccugcugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcguggaggccuucccgcaguccaacgcggucauccaggacgaggagcgcgacauccccgagcggagcuggaacuccggguacgaguggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccgcggcgcugccugaagcccgugauccucaaggacgggcccgagcgggucauccuggcgggccccaugccggugaccguggccagcgccgcccagcgccgggggcgcaucggccggaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgcgagaaguccgccgccaucgacggggaguaccgccuccggggcgaggcccgcaagaccuucgucgagcugaugcggcgcggggaccugcccguguggcucagcuacaagguggcgagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgccgccggccggcgcuccgugagcggggaccucauccuggagaucggcaagcugccgcagcaccucacccagcgggcgcagaacgcccuggacaaccuggucaugcuccacaacuccgagcagggcgggcgcgccuaccggcacgccauggaggagcugcccgacaccaucgagacccugaugcuccuggcgcugaucgccgugcucacgggcggggugacccuguucuuccugagcggccgcgggcucggcaagaccuccaucggccugcugugcgucauggccagcuccgcccuccuguggauggccagcguggagccccacuggaucgcggccuccaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagacgaccaagaaggaccucgggaucggccacgucgcgguggagaaccaccaccacgccaccaugcuggacaucgaccugcaccccgccagcgccuggacccucuacgccguggcgacgaccaucaucaccccgaugaugcggcacaccaucgagaacacgaccgccaacaucucccugaccgccaucgccaaccaggccgcgauccugauggggcucgacaagggcuggcccaucagcaagauggacaucggcgucccccugcuggcccucgggugcuacucccaggugaacccccugacccugacggccgccgugcucaugcuggucgcgcacuacgccaucaucggcccggggcugcaggccaaggccacccgcgaggcccagaagcgcaccgcggccggcaucaugaagaaccccaccguggacgggaucguggccaucgaccucgaccccgucguguacgacgccaaguucgagaagcagcugggccagaucaugcugcucauccugugcacgagccagauccugcucaugcggaccaccugggcccugugcgaguccaucacccuggcgacgggcccccucaccacccugugggaggggagcccgggcaaguucuggaacaccacgaucgccguguccauggccaacaucuuccgcgggagcuaccuggccggcgccggccucgcguucagccugaugaagucccucgggggcgggcggcgcgggaccggggcccagggcgagacccucggcgagaaguggaagcggcagcugaaccagcugagcaaguccgaguucaacaccuacaagcgcagcgggaucauggaggucgaccgguccgaggccaaggagggccuccgccgcggggagacgaccaagcacgccgugagccgcggcaccgcgaagcugcggugguucguggagcgcaaccuggucaagcccgaggggaaggugaucgaccugggcugcggccgcggcgggugguccuacuacugcgccgggcucaagaaggugaccgaggucaagggguacacgaagggcggccccggccacgaggagcccaucccgauggccaccuacggguggaaccuggugaagcugcacagcggcaaggacguguucuucaucccgcccgagaagugcgacacccuccugugcgacaucggggaguccagccccaacccgaccaucgaggagggccgcacgcugcggguccucaagaugguggagcccuggcugcgcgggaaccaguucugcaucaagauccugaaccccuacaugcccuccguggucgagacccucgagcagaugcagcggaagcacggcggcaugcuggugcgcaacccgcugagccggaacuccacccacgagauguacugggugagcugcgggaccggcaacaucgucuccgccgugaacaugaccagccgcaugcuccugaaccgcuucacgauggcccaccggaagcccaccuacgagcgcgacguggaccugggggcgggcacccggcacgucgccguggagcccgagguggccaaccucgacaucaucggccagcgcaucgagaacaucaagcacgagcacaaguccaccuggcacuacgacgaggacaaccccuacaagacgugggccuaccacgggagcuacgaggucaagccguccggcagcgccagcuccauggugaacggggucgugaagcugcugaccaagcccugggacgugauccccauggucacccagaucgcgaugaccgacacgacccccuucggccagcagcggguguucaaggagaagguggacacccgcaccccgaaggccaagcgggggacggcccagaucauggaggucaccgcccgcuggcucuggggcuuccugagccggaacaagaagccccgcaucugcacccgggaggaguucacccgcaaggugcgguccaacgccgcgaucggcgccguguucgucgacgagaaccaguggaacagcgccaaggaggccguggaggacgagcgcuucugggaccuggugcaccgggagcgcgagcuccacaagcaggggaagugcgcgacgugcgucuacaacaugaugggcaagcgggagaagaagcugggggaguucggcaaggccaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgcggacgacaccgccggcugggacacccgcaucaccgaggacgaccuccagaacgaggccaagaucacggacaucauggagccggagcacgcccugcuggccaccagcaucuucaagcucaccuaccagaacaaggugguccgcgugcagcggcccgcgcgcaacgggaccgugauggacgucaucucccggcgcgaccagcggggcagcggccaggugggcacguacggccugaacaccuucaccaacauggaggcccagcugauccgccagauggaguccgaggggaucuucagccccuccgagcucgagacccccaaccuggccgagcgggugcuggacuggcucgagaagcacggcgucgagcgccugaagcggauggccaucagcggggacgacugcguggugaagccgaucgacgaccgcuucgccacggcgcuguccgcccucaacgacaugggcaagguccggaaggacaucccccagugggagcccagcaagggguggaacgacuggcagcagguccccuucugcagccaccacuuccaccagcugaucaugaaggacggccgcgagaucguggucccgugccggaaccaggacgagcuggugggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgcgguccccguggacugggugcccaccucccgcaccacguggagcauccacgcccaccaccaguggaugaccaccgaggacaugcuguccgucuggaaccgcguguggaucgaggagaaccccuggauggaggacaagacccacaucagcuccuggggcgacgugccguaccucgggaagcgggaggaccaguggugcggcagccugaucggccugacggcccgcgccaccugggccaccaacauccaggucgcgaucaaccaggugcggcgccucaucgggaacgagaacuaccuggacuacaugaccuccaugaagcgguucaagaacgacagcgaccccgagggcgcccugugguga

SEQ ID NO: 8769 - RNA, 9879 nt, Artificial Sequence
  derived and/or modified CDS sequence (opt1) from DENV-1__EU482496__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcugaagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8770 - RNA, 9879 nt, Artificial Sequence
  derived and/or modified CDS sequence (opt1) from DENV-1__EU482497__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccagggcaccuggaaccggcaggaccugcuggugaccuucaagaccgcccacgccaagaagcaggaggucguggugcucggcagccaggagggggcgaugcacacggcccugaccggcgccaccgagauccagaccuccgggacgaccaccaucuucgccggccaccugaagugccgccucaagauggacaagcugacccugaaggggaugagcuacgucaugugcacgggcuccuucaagcucgagaaggagguggccgagacccagcacggcaccgugcugguccagaucaaguacgaggggaccgacgcgcccugcaagauccccuucagcacgcaggacgagaagggcgugacccagaacgggcggcugaucaccgccaacccgaucgugaccgacaaggagaagcccgucaacaucgaggccgagccgcccuucggcgaguccuacaucgugaucggcgccggggagaaggcgcugaagcucagcugguucaagaagggcuccagcaucgggaagauguucgaggccacggcccgcggcgcccggcgcauggccauccugggggacaccgcgugggacuucggcuccaucggcgggguguucaccagcgucggcaagcuggugcaccagaucuucgggaccgccuacggcguccucuucuccggggucagcuggacgaugaagaucggcaucggcgugcugcugaccuggcucgggcugaacucccgcagcaccucccugagcaugaccugcaucgccgugggccucgucacgcuguaccugggggugauggugcaggccgacuccggcugcgucaucaacuggaaggggcgggagcucaagugcggcagcggcaucuucgugaccaacgaggugcacaccuggaccgagcaguacaaguuccaggccgacagcccgaagcgccuguccgcggccaucgggaaggccugggaggagggcgucugcgggauccggagcgccacccgccuggagaacaucauguggaagcagaucuccaacgagcucaaccacauccugcuggagaacgacaugaaguucacggugguggucggcgacguggccgggauccucgcgcagggcaagaagaugauccggccccagcccauggaguacaaguacagcuggaaguccuggggcaaggccaagaucaucggggccgacgugcagaacaccaccuucaucaucgacggccccaacaccccggagugccccgacgaccagcgcgccuggaacaucugggaggucgaggacuacggguucggcaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccguggucguggacgagcacugcgggaaccggggcccgucccugcgcaccaccacggugaccgggaagaucauccacgaguggugcugccggagcugcacccugccgccccuccgcuuccggggcgaggacgggugcugguacggcauggagauccgccccgucaaggagaaggaggagaaccuggugaaguccauggugagcgccggcagcggggaggucgacuccuucagccucggccugcugugcaucuccaucaugaucgaggaggugaugcggagccgcuggucccggaagaugcucaugaccgggacgcuggccguguucuuccugcucaucaugggccagcugaccuggaacgaccugauccgccucugcaucauggucggggccaacgcgagcgaccgcaugggcaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggggacggccuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcuggggagccucggcugcaagccgcugaccauguuccugaucgcggagaacaagaucugggggcggcgcuccuggccccucaacgagggcaucauggccgucgggaucgugagcauccugcugagcucccuccugaagaacgacgugccccuggccggcccccucaucgccggcgggaugcugaucgccugcuacgucaucagcggcuccagcgcggaccugucccucgagaaggccgccgaggugagcugggaggaggaggccgagcacuccggggccagccacaacauccugguggagguccaggacgacggcaccaugaagaucaaggacgaggagcgggacgacacccugaccauccuccugaaggcgacgcugcucgccguguccgggguguacccgcugagcauccccgccacccuguucgucugguacuucuggcagaagaagaagcagcgcuccggcgugcucugggacacccccagcccgcccgagguggagcgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccggaucacggaggacgaccugcagaacgaggcccgcaucaccgacaccauggagccggagcacgcccuccuggcgcgcuccaucuucaagcugaccuaccagaacaaggugguccgggugcagcgccccgccaagaacggcacggugauggacgucaucagccggcgcgaccagcggggguccggccaggugggcaccuacgggcucaacaccuucaccaacauggaggcccagcugauccgccagauggagagcgagggcaucuucucccccagcgagcuggagacgcccaaccucgccgagcgggugcuggacuggcuggagaaguacggggucgagcgccucaagcggauggccaucuccggcgacgacugcguggugaagccgaucgacgaccgcuucgcgaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgcgugccucggcaaguccuacgcccagauguggcagcugauguacuuccaccggcgcgaccugcggcucgccgccaacgcgaucugcagcgccguccccguggacuggauccccacgucccgcaccaccuggagcauccacgcccaccaccaguggaugaccacggaggacaugcuguccguguggaaccgcgucuggaucgaggagaaccccuggauggaggacaagacccacaucagcuccuggggcgacgugccguaccugggcaagcgggaggaccaguggugcggcagccucaucgggcugaccgcccgcgccaccugggcgaccaacauccagguggccaucaaccagguccggcgccugaucggcaacgagaacuaccucgacuacaugacguccaugaagcgguucaagaacgagagcgaccccgagggggcccugugguga

SEQ ID NO: 8771 - RNA, 9879 nt, Artificial Sequence
  derived and/or modified CDS sequence (opt1) from DENV-1__EU482499__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcugaagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccugggaggacgucccguaccugggcaagcgcgaggaccaguggugcgggagccucaucggccugaccgcccgggccaccugggcgaccaacauccagguggccaucaaccaggugcgccggcugaucggcaacgagaacuaccucgacuacaugaccuccaugaagcgcuucaagaacgagggggaccccgagggcgcccugugguga

SEQ ID NO: 8772 - RNA, 9879 nt, Artificial Sequence
  derived and/or modified CDS sequence (opt1) from DENV-1__EU482500__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagaucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcuccugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccucucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggaggccgagcacgcgcuccuggccaaguccaucuucaagcugaccuaccagaacaaggucgugcgcgugcagcggccggccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcguccuggacuggcuggagaaguacggcguggagcggcucaagcgcauggcgaucuccggggacgacugcguggucaagcccaucgacgaccgguucgccacggcccugaccgcccugaacgacaugggcaaggugcgcaaggacaucccgcagugggagcccagcaagggguggaacgacuggcagcagguccccuucugcucccaccacuuccaccagcucaucaugaaggacggccgggagaucgucgugcccugccgcaaccaggacgagcuggugggccgggcccgcgucagccagggggcgggcuggagccugcgggagaccgccugccucgggaaguccuacgcccagauguggcagcugauguacuuccaccgccgggaccugcgccucgccgcgaacgccaucugcagcgccgugccgguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugcccuaccuggggaagcgcgaggaccaguggugcggcagccucaucggccugaccgcccgggcgaccugggccaccaacauccaggucgccaucaaccaggugcgccggcugaucgggaacgagaacuaccucgacuacaugaccuccaugaagcgcuucaagaacgagggcgacccggagggggcccugugguga

SEQ ID NO: 8773 - RNA, 9879 nt, Artificial Sequence
  derived and/or modified CDS sequence (opt1) from DENV-1__EU482501__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacggcaccgugauggacgucaucagccgccgggaccagcgcggguccggccaggugggcacguacgggcucaacaccuucaccaacauggaggcccagcugauccggcagauggagagcgagggcaucuucucccccagcgagcuggagacccccaaccucgccgagcgcgugcuggacuggcuggagaaguacggggucgagcggcucaagcgcauggccaucuccggcgacgacugcguggugaagccgaucgacgaccgguucgcgacggcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgcgugccucggcaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgcgaggaccaguggugcggcagccucaucgggcugaccgcccgggccaccugggcgaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8774 - RNA, 9879 nt, Artificial Sequence
  derived and/or modified CDS sequence (opt1) from DENV-1__EU482504__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggucacgcugcugagccucaccuucaucaagaccaccuucucccugcacuacgccuggaagacgauggccauggugcugagcaucgugucccucuucccccugugccugagcaccaccucccagaagaccacguggcuccccguccugcugggcagccucgggugcaagccgcugaccauguuccugaucgccgagaacaagaucuggggccggcgcuccuggccccucaacgaggggaucauggcggugggcaucgugagcauccugcugagcucccuccugaagaacgacgucccccuggccgggccccucaucgccggcggcaugcugaucgccugcuacgugaucagcggguccagcgccgaccugucccucgagaaggcggccgaggugagcugggaggaggaggccgagcacuccggcgccagccacaacauccuggucgaggugcaggacgacgggaccaugaagaucaaggacgaggagcgggacgacacccugaccauccuccugaaggccacgcugcucgcgguguccggcgucuacccgcugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgccgugcucauguaccaggggaagcgccuggagcccagcugggccuccgugaagaaggaccugaucagcuacggcggcggguggcggcuccagggcuccuggaacaccggggaggagguccaggugaucgcgguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccuguacggcaacgggguggugaccaccagcggcacguacgucagcgccaucgcgcaggccaaggccucccaggaggggccgcuccccgagaucgaggacgagguguuccggaagcgcaaccugaccaucauggaccugcaccccggcagcgggaagacccggcgcuaccucccggccaucgugcgggaggcgaucaagcgcaagcugcgcacccugauccucgcccccacgcgggucguggccuccgagauggccgaggcccugaagggcaugcccauccgcuaccagaccaccgcggucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgccgcccggggguacaucagcacccgcgucggcaugggggaggcggccgccaucuucaugacggccacgccgcccggcuccguggaggccuucccgcagagcaacgcggugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgccgaccgggugaucgacccgcgccggugccugaagcccgucauccugaaggacgggcccgagcgcgugauccucgcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcugcucgacaacaucaacacccccgagggcaucauccccgcccuguucgagccggagcgcgagaaguccgccgccaucgacggggaguaccggcugcgcggcgaggcccggaagacguucguggagcucaugcgccgcggggaccugcccgucuggcuguccuacaagguggcgagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgccgccggccgccggagcguguccggggaccugaucagcgagaucggcaagcucccgcagcaccugacccagcgcgcgcagaacgcccuggacaaccucgugaugcugcacaacuccgagcagggcgggcgggccuaccgccacgccauggaggagcugcccgacacgaucgagacccucaugcugcuggcgcucaucgccguccugaccggcggggugacccuguucuuccucagcggccgggggcugggcaagaccuccaucggccugcucugcgugauggccagcuccguccugcuguggauggccagcguggagccccacuggaucgccgcguccaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgccguggagaaccaccaccacgcggccaugcuggacguggaccuccaccccgccagcgccuggacgcuguacgccgucgcgaccaccaucaucaccccgaugaugcgccacacgaucgagaacaccaccgccaacaucucccugaccgccaucgccaaccaggccgcgauccucauggggcuggacaagggcuggcccaucagcaagauggacaucggcgugccccugcucgcccuggggugcuacucccaggugaacccccugacgcucaccgccgccguccugaugcugguggcgcacuacgccaucaucggcccggggcuccaggccaaggccacccgcgaggcccagaagcggaccgcggccggcaucaugaagaaccccacgguggacgggaucgucgccaucgaccuggaccccgugguguacgacgccaaguucgagaagcagcugggccagaucaugcuccugauccugugcaccagccagauccuccugaugcgcaccaccugggcccugugcgaguccaucacgcucgcgaccggcccccugaccacccugugggaggggagcccgggcaaguucuggaacacgaccaucgccgucuccauggccaacaucuuccgggggagcuaccucgccggcgccggccuggcguucagccugaugaagucccucgggggcgggcgccggggcaccggggcccagggcgagacccugggcgagaaguggaagcgccagcugaaccagcucagcaaguccgaguucaacacguacaagcggagcgggaucauggagguggaccgcuccgaggccaaggagggccugaagcgcggggagaccaccaagcacgccgugagccgcggcaccgcgaagcugcggugguucgucgagcgcaaccucgugaagcccgaggggaaggugaucgaccugggcugcggccgcggcgggugguccuacuacugcgccgggcugaagaaggucacggaggugaagggguacaccaagggcgggcccggccacgaggagcccaucccgauggccaccuacggguggaaccuggugaagcuccacagcggcaaggacgucuucuucaucccgcccgagaagugcgacacccugcugugcgacaucggggaguccagccccaacccgacgaucgaggagggccgcacccuccgggugcugaagaugguggagcccuggcugcgcgggaaccaguucugcaucaagauccucaaccccuacaugcccuccgucguggagacccuggagcagaugcagcggaagcacggcggcaugcuggugcgcaacccgcucagccggaacuccacccacgagauguacugggucagcugcgggaccggcaacaucguguccgccgugaacaugacgagccgcaugcugcugaaccgcuucaccauggcccaccggaagcccaccuacgagcgcgacgucgaccucggggcgggcacccggcacguggccguggagcccgaggucgccaaccuggacaucaucggccagcgcaucgagaacaucaagcacgagcacaaguccacguggcacuacgacgaggacaaccccuacaagaccugggccuaccacgggagcuacgaggugaagccguccggcagcgccagcuccauggucaacgggguggugaagcugcucaccaagcccugggacgucauccccauggugacccagaucgcgaugacggacaccacccccuucggccagcagcggguguucaaggagaaggucgacacccgcacgccgaaggccaagcgggggaccgcccagaucauggaggugaccgccaaguggcuguggggcuuccugagccgcaacaagaagccccggaucugcacccgcgaggaguucacgcggaaggugcgcuccaacgccgcgaucggcgccgucuucguggacgagaaccaguggaacagcgccaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgcggacgacaccgccggcugggacacccggaucacggaggacgaccugcagaacgaggcccgcaucaccgacaucauggagccggagcacgcccugcucgccaagagcaucuucaagcugaccuaccagaacaaggucgugcgcgugcagcggcccgcgaagaacgggaccgucauggacgugaucucccgccgggaccagcgcggcagcggccagguggggacguacggccugaacaccuucaccaacauggaggcccagcucauccggcagauggaguccgaggggaucuucagccccuccgagcuggagacccccaaccuggccgagcgcguccucgacuggcuggagaaguacggcaucgagcggcugaagcgcauggccaucagcggggacgacugcguggugaagccgaucgacgaccgguucgccacggcgcucaccgcccugaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcucgugggccgggcccgcgugagccagggggccggcuggucccugcgggagaccgccugccugggcaagagcuacgcgcagauguggcagcucauguacuuccaccgccgggaccugcgccuggccgccaacgccaucugcuccgcgguccccguggacuggauccccaccagccggacgaccugguccauccacgcccaccaccaguggaugaccaccgaggacaugcucagcguguggaaccgcgucuggaucgaggagaaccccuggauggaggacaagacgcacaucuccagcuggggcgacgugccguaccuggggaagcgcgaggaccaguggugcggcucccugaucggccucaccgcccgggccaccugggccaccaacauccagguggcgaucaaccagguccgccggcugaucgggaacgagaacuaccuggacuacaugaccagcaugaagcgcuucaagaacgaguccgaccccgagggcgcccucugguga

SEQ ID NO: 8775 - RNA, 9879 nt, Artificial Sequence
  derived and/or modified CDS sequence (opt1) from DENV-1__EU482505__SS-prME
agcgugaccaugcugcucaugcugaugcccaccgcgcuggccuuccaccucaccacccggggcggggagccccacaugaucguguccaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaggccuggcuggugcacaagcagugguuccucgaccugccgcugcccuggaccagcggggccagcaccucccaggagacguggaaccggaaggaccuccuggugaccuucaagaccgcgcacgccaagaagcaggaggucguggugcugggcagccaggagggcgccaugcacaccgcccucacgggggccaccgagauccagaccuccggcaccacgaccaucuucgcggggcaccugaagugccgccugaagauggacaagcucacccugaagggcaugagcuacgucaugugcaccggguccuucaagcuggagaaggagguggccgagacgcagcacggcaccgugcucguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggcggagccgcccuucggggaguccuacaucgugaucggcgccggcgagaaggcccugaagcugagcugguucaagaagggguccagcaucggcaagauguucgaggccaccgcccgcggggcgcggcgcauggccauccucggcgacacggccugggacuucggguccaucggcggcguguucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggcggacuccgggugcgucaucaacuggaagggccgggagcugaagugcgggagcggcaucuucgugacgaacgaggugcacaccuggaccgagcaguacaaguuccaggccgacagcccgaagcgccucuccgccgccaucggcaaggccugggaggagggggucugcggcauccggagcgcgacccgccuggagaacaucauguggaagcagaucuccaacgagcugaaccacauccuccuggagaacgacaugaaguucaccgugguggucggggacguggccggcauccuggcccaggggaagaagaugauccggccccagcccauggagcacaaguacagcuggaaguccuggggcaaggccaagaucaucggcgcggacgugcagaacgccacguucaucaucgacgggcccaacaccccggagugccccgacgaccagcgcgccuggaacaucugggaggucgaggacuacggcuucgggaucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagaccuggaagcucgcccgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucgaccucugcgagggcaccaccguggucguggacgagcacugcggcaaccgggggccgucccugcgcacgaccaccgugaccggcaagaucauccacgaguggugcugccggagcugcacgcugccgccccugcgcuucaagggggaggacggcugcugguacgggauggagauccggcccgucaaggagaaggaggagaaccuggugaaguccauggugagcgcgggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucaccuggaacgaccugauccggcugugcaucauggucggcgccaacgccagcgaccgcauggggaugggcacgacguaccucgcccugauggcgaccuucaagaugcgcccgauguucgccguggggcuccuguuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggcgacccuccugagccugaccuucaucaagacgaccuucucccuccacuacgccuggaagaccauggccaugguccugagcaucgugucccuguucccccucugccugagcaccacgucccagaagaccaccuggcugcccgugcuccugggcagccuggggugcaagccgcucaccauguuccugaucgccgagaacaagaucuggggccgcaaguccuggccccugaacgaggggaucauggccgucggcaucgugagcauccuccugagcucccugcucaagaacgacgugccccuggcggggccccugaucgccggcggcaugcucaucgccugcuacgucaucagcggguccagcgccgaccugucccuggagaaggccgcggaggugagcugggaggaggaggccgagcacuccggcgccagccacaacauccucguggagguccaggacgacgggacgaugaagaucaaggacgaggagcgggacgacacccugaccauccugcucaaggccacccugcuggccguguccggcguguacccgcucagcauccccgcgacccuguucgucugguacuucuggcagaagaagaagcagcgcuccggggugcugugggacacgcccuccccgcccgagguggagcgggccguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagacggcgcccgggaccuucaagaccagcgagggcgaggucggcgccaucgcccucgacuucaagcccgggaccuccggcagccccaucgugaaccgcgaggggaagaucgugggccuguacggcaacggggucgugacgaccagcggcaccuacguguccgccaucgcgcaggccaaggccagccaggaggggccccugccggagaucgaggacgaggucuuccggaagcgcaaccucaccaucauggaccugcaccccggcuccgggaagacgcggcgcuaccugcccgccaucgugcgggaggccaucaagcgcaagcuccggacccugauccuggcgccgacccgcguggucgccagcgagauggccgaggcccucaagggcaugcccauccgcuaccagaccacggccgugaaguccgagcacaccggcaaggagaucguggaccugaugugccacgcgaccuucaccaugcggcugcucagccccguccgcgugcccaacuacaacaugaucaucauggacgaggcccacuucacggacccguccagcaucgccgcccggggguacaucuccacccgcgugggcaugggggaggccgcggccaucuucaugaccgccacgccgcccggcagcgucgaggccuucccccaguccaacgcggugauccaggacgaggagcgggacaucccggagcgcagcuggaacuccggguacgaguggaucacggacuuccccggcaagaccgugugguucguccccagcaucaaguccggcaacgacaucgccaacugccugcggaagaacgggaagcgcgugauccagcugagccggaagaccuucgacaccgaguaccagaagacgaagaacaacgacugggacuacguggucaccaccgacaucuccgagaugggcgccaacuuccgcgccgaccgggugaucgacccccgccggugccucaagccggugauccugaaggacgggcccgagcgcgucauccuggccggccccaugcccgugaccgucgcgagcgccgcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgccaucgacggggaguaccgccugcgcggcgaggcccggaagaccuucguggagcugaugcgccgcggggaccucccgguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcgcgcacguacagcgacccccuggcccuccgggaguucaaggaguucgccgccggccgccgguccgucagcggggaccugauccuggagaucggcaagcucccccagcaccugacccagcgcgcgcagaacgcccuggacaaccucgugaugcugcacaacuccgagcagggcgggcgggccuaccgccacgccauggaggagcugccggacaccaucgagacccucaugcugcuggcccucaucgcggugcugacgggcggggucacccuguucuuccucagcggccgggggcugggcaagaccuccaucggccugcucugcgugauggccagcuccgugcugcuguggauggccagcgucgagccccacuggaucgccgccuccaucauccucgaguucuuccugauggugcugcucauccccgagcccgaccgccagcggaccccgcaggacaaccagcuggcguacguggucaucgggcuccucuucaugauccugaccguggccgccaacgagaugggccugcucgagacgaccaagaaggaccuggggaucggccacguggccgucgagaaccaccaccacgccgcgaugcuggacguggaccuccaccccgccagcgccuggacccuguacgccguggccaccacgaucaucacccccaugaugcgccacaccaucgagaacaccacggcgaacaucucccugaccgccaucgccaaccaggccgcgauccucauggggcuggacaagggcuggccgaucagcaagauggacaucggcgucccccugcucgcccuggggugcuacucccaggugaacccccugacccucaccgccgccgugcugaugcuggucgcccacuacgcgaucaucggccccgggcuccaggccaaggccacgcgggaggcccagaagcgcaccgccgcgggcaucaugaagaacccgaccguggacgggaucguggccaucgaccuggaccccgucguguacgacaccaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgccguguccauggcgaacaucuuccgggggagcuaccucgccggcgccggccuggccuucagccugaugaagucccucgggggcgggcgccggggcaccggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagacgaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugaccgaggucaagggguacacgaagggcgggcccggccacgaggagcccauccccauggcgaccuacggguggaaccuggugaagcuccacagcggcaaggacguguucuucaucccgcccgagaagugcgacacccugcugugcgacaucggggaguccagccccaaccccaccaucgaggagggccgcacgcuccggguccugaagaugguggagccguggcugcgcgggaaccaguucugcaucaagauccucaaccccuacaugcccuccguggucgagacccuggagcagaugcagcggaagcacggcggcaugcuggugcgcaacccccucagccggaacuccacccacgagauguacugggugagcugcgggaccggcaacaucgucuccgccgugaacaugaccagccgcaugcugcugaaccgguucacgauggcccaccgcaagccgaccuacgagcgcgacguggaccucggggccggcacccggcacgucgccguggagcccgagguggcgaaccuggacaucaucggccagcgcaucgagaacaucaagcacgagcacaaguccaccuggcacuacgacgaggacaaccccuacaagacgugggccuaccacgggagcuacgaggucaagcccuccggcagcgccagcuccauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcgcagaucauggaggucaccgccaaguggcuguggggcuuccugagccgcaacaagaagccgcggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucaaccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaaggugguccgcgugcagcggccggccaagaacgggaccgugauggacgucaucagccgccgcgaccagcggggcuccggccaggugggcaccuacggccugaacacguucaccaacauggaggcccagcucauccgccagauggagagcgaggggaucuucucccccagcgagcuggagacccccaaccuggcgggccgggugcucgacuggcuggagaagcacggggucgagcgccugaagcggauggccaucuccggcgacgacugcguggugaagcccaucgacgaccgcuucgccaccgcccucacggcccugaacgacauggggaagguccggaaggacaucccgcagugggagcccagcaagggcuggaacgacuggcagcagguccccuucugcucccaccacuuccaccagcugaucaugaaggacggccgcgagaucgugguccccugccggaaccaggacgagcucguggggcgcgcgcgggugagccagggcgccggguggagccugcgcgagaccgccugccugggcaaguccuacgcccagauguggcagcucauguacuuccaccggcgcgaccugcggcuggcggccaacgccaucugcagcgccgucccgguggacugggugcccaccucccgcaccacguggagcauccacgcccaccaccaguggaugaccaccgaggacaugcucuccgucuggaaccggguguggaucgaggagaaccccuggauggaggacaagacccacaucagcuccuggggcgacgugcccuaccugggcaagcgcgaggaccaguggugcggcagccugaucgggcucacggcgcgggccaccugggccaccaacauccaggucgccaucaaccaggugcgccgccugaucggcaacgagaacuaccuggacuacaugaccuccaugaagcgguucaagaacgagaucgacccggagggggcccucugguga

SEQ ID NO: 8776 - RNA, 9879 nt, Artificial Sequence
  derived and/or modified CDS sequence (opt1) from DENV-1__EU482506__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcauccugcucaccuggcugggccugaacagccgcuccaccagccucuccaugaccugcaucgccgucgggcuggugacgcuguaccucggcgugaugguccaggccgacagcgggugcgugaucaacuggaagggccgggagcugaagugcggguccggcaucuucgugaccaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacgguggucgugggggacguggccggcauccuggcgcaggggaagaagaugauccggccccagcccauggaguacaaguacuccuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagacgugcaucuggcccaagagccacacccucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgucgugguggacgagcacugcggcaaccgggggccgagccuccgcaccaccacggucaccggcaagaucauccacgaguggugcugccgguccugcacccugccgccccugcgcuuccgcggggaggacggcugcugguacgggauggagauccgccccgugaaggagaaggaggagaaccucgucaagagcauggucuccgccggcagcggcgagguggacagcuucucccuggggcugcucugcaucagcaucaucaucgaggaggugaugcggucccgcuggagccggaagaugcugaugaccggcacgcuggccgucuucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgugggccugcuguuccgccggcucaccagccgcgagguccugcugcucaccaucgggcugucccugguggccagcguggagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccaugguccucuccaucgugagccuguucccccugugccucuccaccaccagccagaagaccacguggcugcccguccugcucggcucccuggggugcaagccgcugaccauguuccucaucgcggagaacaagaucuggggccggcgcagcuggccccugaacgaggggaucauggccgugggcaucguguccauccugcucagcagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggaccaugaagaucaaggacgaggagcgggacgacacccucaccauccugcugaaggcgacgcuccuggccgugagcggcgucuacccgcuguccauccccgccacccucuucgugugguacuucuggcagaagaagaagcagcgcagcggggugcugugggacacccccagcccgcccgaggucgagcgggccgugcuggacgacggcaucuaccgcaucaugcagcggggccugcucgggcgcagccaggugggcgucgggguguuccaggagaacguguuccacaccauguggcacgucacgcggggcgccgugcugauguaccaggggaagcgccuggagcccuccugggcgagcgugaagaaggaccucaucuccuacggcggcggguggcggcugcagggcagcuggaacaccggggaggagguccaggugaucgccguggagcccggcaagaaccccaagaacguccagaccgcccccgggaccuucaagacgcccgagggcgaggugggcgccaucgcccuggacuucaagcccgggaccuccggcagccccaucgugaaccgcgaggggaagaucgucggccucuacggcaacgggguggugaccaccuccggcacguacgucagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucgugcgggaggccaucaagcgcaagcugcgcacccucauccuggcccccacgcgggucguggccagcgagauggccgaggcgcugaagggcaugcccauccgcuaccagaccaccgccgugaaguccgagcacaccggcaaggagaucgucgaccucaugugccacgccacguucaccaugcggcugcugagccccgugcgcgugccgaacuacaacaugaucaucauggacgaggcccacuucaccgaccccuccagcaucgccgcgcggggguacaucuccacccgcgucggcaugggggaggccgccgccaucuucaugacggccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccuccggaagaacgggaagcgcgugauccagcugagccggaagacguucgacaccgaguaccagaagaccaagaacaacgacugggacuacgucgugaccacggacaucuccgagaugggcgccaacuuccgcgcggaccgggugaucgacccgcgccggugccugaagcccgucauccucaaggacgggcccgagcgcgugauccuggccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucguggagcugaugcgccgcggggaccugcccgucuggcucagcuacaagguggccuccgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggugaugcuccacaacuccgagcagggcgggcgggccuaccgccacgcgauggaggagcugcccgacacgaucgagacccugaugcuccuggcccugaucgccguccucaccggcggggugacccuguucuuccugagcggccgggggcucggcaagaccuccaucggccugcugugcgugauggccagcuccguccuccuguggauggccagcguggagccccacuggaucgcggccuccaucauccuggaguucuuccucauggugcugcugauccccgagccggaccgccagcggacgccccaggacaaccagcucgccuacgucgugaucgggcugcuguucaugauccucaccguggccgccaacgagaugggccugcuggagaccaccaagaaggaccucgggaucggccacgucgcgguggagaaccaccaccacgccgccaugcuggacguggaccugcaccccgccagcgccuggacgcucuacgcggucgccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggugaacccccugacgcugaccgccgcgguccucaugcugguggcccacuacgccaucaucggcccggggcugcaggccaaggccacccgcgaggcgcagaagcggaccgccgccggcaucaugaagaaccccacgguggacgggaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccgucuccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggugagccgcggcaccgccaagcugcggugguucgucgagcgcaaccuggugaagcccgaggggaaggugaucgaccugggcugcggccgcggcgggugguccuacuacugcgccgggcucaagaaggucacggaggugaagggguacaccaagggcggccccggccacgaggagcccaucccgauggccaccuacggguggaaccuggugaagcugcacagcggcaaggacgucuucuucaucccgcccgagaagugcgacacccuccugugcgacaucggggaguccagccccaacccgacgaucgaggagggccgcacccugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugacgagccgcaugcuccugaaccgcuucaccauggcgcaccggaagcccaccuacgagcgcgacgucgaccugggggccggcacccggcacguggccguggagcccgaggucgccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcucuggggcuuccugagccgcaacaagaagccccggaucugcacccgcgaggaguucacgcggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggccggcuggagccuccgggagaccgcgugccugggcaagagcuacgcccagauguggcagcugauguacuuccaccgccgggaccuccgccuggccgccaacgcgaucugcuccgccgugcccguggacuggauccccaccagccggacgaccugguccauccacgcccaccaccaguggaugaccaccgaggacaugcugagcgucuggaaccgcguguggaucgaggagaaccccuggauggaggacaagacgcacaucuccagcuggggcgacgugccguaccucgggaagcgcgaggaccaguggugcggcucccugaucggccugaccgcccgggccaccugggcgaccaacauccaggucgccaucaaccaggugcgccggcucaucgggaacgagaacuaccuggacuacaugaccagcaugaagcgcuucaagaacgagggcgaccccgagggggcccugugguga

SEQ ID NO: 8777 - RNA, 9879 nt, Artificial Sequence
  derived and/or modified CDS sequence (opt1) from DENV-1__EU482509__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuuccugacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccgccgggaagcucgugcaccagaucuucggcaccgccuacgggguccuguucagcggcguguccuggacgaugaagaucgggaucggcgugcugcucaccuggcugggccugaacagccgcuccaccagccucuccaugaccugcaucgccgucgggcuggugacgcuguaccucggcgugaugguccaggccgacagcgggugcgugaucaacuggaagggccgggagcugaagugcggguccggcaucuucgugaccaacgagguccacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucacgguggucgugggggacguggcgggcauccuggcccaggggaagaagaugauccggccccagcccauggaguacaaguacuccuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugaagcuccgggacuccuacacccaggugugcgaccaccgccugaugagcgccgccaucaaggacuccaaggccguccacgccgacaugggcuacuggaucgagagcgagaagaacgagaccuggaagcuggcgcgggccuccuucaucgaggugaagacgugcaucuggcccaagagccacacccucugguccaacggcgugcuggagagcgagaugaucguccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaucaucgaggaggucaugcggucccgcuggagccggaagaugcugaugaccggcacgcuggccguguucuuccuccugaucauggggcagcugaccuggaacgaccucauccgccugugcaucauggugggcgcgaacgccuccgaccgcauggggaugggcaccaccuaccuggcccucauggccacguucaagaugcggccgauguucgccgucggccugcuguuccgccggcucaccagccgcgaggugcugcugcucaccaucgggcugucccugguggcgagcgucgagcuccccaacucccuggaggagcugggcgacgggcucgccaugggcaucaugauccugaagcugcucaccgacuuccagagccaccagcugugggccacgcugcucucccugaccuucaucaagaccaccuucagccugcacuacgccuggaagacgauggcgauggugcucuccaucgucagccuguucccccugugccucuccaccaccagccagaagaccacguggcugcccgugcugcucggcucccuggggugcaagccgcugaccauguuccucaucgccgagaacaagaucuggggccggcgcagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagaaggccgccgaggucuccugggaggaggaggccgagcacagcggcgcgucccacaacauccugguggaggugcaggacgacgggaccaugaagaucaaggacgaggagcgggacgacacccucaccauccugcugaaggccacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgcggugcugauguaccaggggaagcgccuggagcccuccugggccagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcgcuggacuucaagcccgggaccuccggcagccccaucgucaaccgcgaggggaagaucgugggccucuacggcaacgggguggucaccaccuccggcacguacgugagcgccaucgcccaggccaaggcgagccaggaggggccgcugcccgagaucgaggacgagguguuccggaagcgcaaccugaccaucauggaccuccaccccggcuccgggaagacccggcgcuaccugccggccaucguccgggaggccaucaagcgcaagcugcgcacccucauccuggcccccacgcgggugguggccagcgagauggcggaggcccugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgcggcccggggguacaucuccacccgcgugggcaugggggaggccgccgccaucuucaugacggcgacgccgcccggcagcguggaggccuucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgcgaacuuccgcgccgaccgggucaucgacccgcgccggugccugaagcccgugauccucaaggacgggcccgagcgcgugauccuggccggccccaugccggucaccguggccagcgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgcggccggccgccgguccgugagcggggaccucauccuggagaucggcaagcugccgcagcaccucacccagcgcgcccagaacgcccuggacaaccuggucaugcuccacaacuccgagcagggcgggcgggcguaccgccacgccauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucgggcugcuguucaugauccucaccgucgccgcgaacgagaugggccugcuggagaccaccaagaaggaccucgggaucggccacguggccguggagaaccaccaccacgccgccaugcuggacgucgaccugcaccccgccagcgcguggacgcucuacgccguggccaccaccaucaucaccccgaugaugcgccacacgaucgagaacaccaccgccaacaucucccugaccgccaucgcgaaccaggccgccauccugauggggcucgacaagggcuggcccaucagcaagauggacaucggcgugccccugcuggcccucgggugcuacucccaggucaacccccugacgcugaccgcggccgugcucaugcugguggcccacuacgccaucaucggcccggggcugcaggccaaggcgacccgcgaggcccagaagcggaccgccgccggcaucaugaagaaccccacggucgacgggaucguggccaucgaccucgaccccguggucuacgacgcgaaguucgagaagcagcugggccagaucaugcugcucauccugugcaccagccagauccugcucaugcgcaccaccugggcccugugcgaguccaucacgcuggccaccggcccccucaccacccugugggaggggagcccgggcaaguucuggaacacgaccaucgccguguccauggccaacaucuuccgggggagcuaccuggcgggcgccggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggcgaaggagggccucaagcgcggggagaccaccaagcacgccgucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgcggucaacaugacgagccgcaugcuccugaaccgcuucaccauggcccaccggaagcccaccuacgagcgcgacguggaccugggggccggcacccggcacguggccgucgagcccgagguggccaaccucgacaucaucggccagcgcaucgagaacaucaagcacgagcacaaguccacguggcacuacgacgaggacaaccccuacaagaccugggcguaccacgggagcuacgaggugaagccguccggcagcgccuccagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgcgaaguggcucuggggcuuccugagccgcaacaagaagccccggaucugcacccgcgaggaguucacgcggaagguccgcuccaacgccgccaucggcgccguguucguggacgagaaccaguggaacagcgcgaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcgcugcuggccaagagcaucuucaagcucaccuaccagaacaagguggugcgcguccagcggcccgccaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagacccccaaccuggccgagcgcgugcuggacuggcucgagaaguacggcguggagcggcugaagcgcauggcgaucagcggggacgacugcgucgugaagccgaucgacgaccgguucgccacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggcgggcuggagccuccgggagaccgccugccugggcaagagcuacgcccagauguggcagcugauguacuuccaccgccgggaccuccgccuggccgcgaacgccaucugcuccgccgugcccgucgacuggauccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgcgaggaccaguggugcggcucccugaucggccugaccgcccgggcgaccugggccaccaacauccagguggccaucaaccaggugcgccggcucaucgggaacgagaacuaccuggacuacaugaccagcaugaagcgcuucaagaacgagggcgagcccgagggggcccugugguga

SEQ ID NO: 8778 - RNA, 9879 nt, Artificial Sequence
  derived and/or modified CDS sequence (opt1) from DENV-1__EU482510__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacguggacugcuggugcaacaccacggacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagaagguggagaccugggcccuccggcaccccggguucacggugaucgcccuguuccuggcccacgcgaucggcaccagcaucacccagaaggggaucaucuucauccuccugaugcuggucacccccuccauggccaugcgcugcgugggcaucggcagccgggacuucguggaggggcucuccggcgccacgugggucgacguggugcuggagcacgggagcugcgucaccaccauggccaaggacaagcccacccuggacaucgagcuccugcgcacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccggcaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccgccucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgggaagggcgugacccagaacgggcggcugaucacggccaacccgaucgucaccgacaaggagaagcccgugaacaucgaggccgagccgcccuucggcgagagcuacaucgugaucggcgccggggagaaggcgcugaagcucuccugguucaagaagggcagcuccaucgggaagauguucgaggccaccgcccgcggcgcccggcgcauggccauccugggggacaccgcgugggacuucggcagcaucggcggggucuucacguccgugggcaagcuggugcaccagaucuucgggaccgccuacggcguccucuucagcgggguguccuggaccaugaagaucggcaucggcgugcugcugaccuggcucgggcugaacagccgcuccacgagccuguccaugaccugcaucgccgucggccucgugacccuguaccugggggugaugguccaggccgacagcggcugcgugaucaacuggaaggggcgggagcucaagugcggcagcggcaucuucgugaccaacgagguccacacguggaccgagcaguacaaguuccaggccgacuccccgaagcgccugagcgcggccaucgggaaggccugggaggagggcgugugcgggauccgguccgccacccgccuggagaacaucauguggcggcagaucagcaacgagcucaaccacauccugcuggagaacgacaugaaguucaccguggucgugggcgacguggucgggauccucgcccagggcaagaagaugauccgcccccagcccauggagcacaaguacuccuggaaguccuggggcaaggcgaagaucaucggggccgacgugcagaacaccacguucaucaucgacggccccaacaccccggagugccccgacgaccagcgggccuggaacaucugggagguggaggacuacggguucggcaucuucaccaccaacaucuggcugaagcugcgcgacuccuacacgcaggucugcgaccaccggcucaugagcgccgcgaucaaggacuccaaggccgugcacgccgacaugggcuacuggaucgagagcgagaagaacgagaccuggaagcuggcccgcgccuccuucaucgaggugaagaccugcaucuggcccaagagccacacccugugguccaacgggguccucgagagcgagaugaucauccccaagaucuacggcgggccgaucucccagcacaacuaccggcccggcuacuucacgcagaccgcggggcccuggcaccugggcaagcuggagcucgacuucgaccugugcgagggcaccaccgugguggucgacgagcacugcgggaaccgcggcccgagccugcggacgaccaccgugaccgggaagaucauccacgaguggugcugccgcuccugcacgcugccgccccuccgguucaagggcgaggacgggugcugguacggcauggagauccgccccgugaaggagaaggaggagaaccuggucaagagcauggugagcgccggcuccggggagguggacagcuucucccucggccugcugugcaucagcaucaugaucgaggaggucaugcggucccgcuggagccggaagaugcucaugaccgggacccuggccguguucuuccugcucaucaugggccagcugaccuggaacgaccugauccgcuccugcaucauggugggggccaacgccagcgaccgcaugggcaugggcacgaccuaccucgcgcugauggccaccuucaagaugcggccgauguucgccgucgggcuccuguuccgccggcugaccucccgcgaggugcugcuccugacgaucggccugagccucgucgccuccguggagcugcccaacagccuggaggagcucggggacggccuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcuggggagccucggcugcaagccgcugaccauguuccugaucgccgagaacaagaucugggggcgcaagagcuggccccucaacgagggcaucauggcgguggggaucgucuccauccugcugagcucccuccugaagaacgacgugccccuggccggcccccucaucgccggcgggaugcugaucgccugcuacgugaucagcggcuccagcgccgaccugucccucgagaaggcggccgaggucagcugggaggaggaggccgagcacuccggggccagccacaacauccugguggaggugcaggacgacggcacgaugaagaucaaggacgaggagcgcgacgacacccugaccauccuccugaaggccacccugcucgcggucuccgggguguacccgcugagcauccccgccacccuguucgugugguacuucuggcagaagaagaagcagcgguccggcguccucugggacacgcccagcccgcccgagguggagcgcgccgugcuggacgacggcaucuaccggaucaugcagcgcgggcugcugggccggucccaggucggggugggcguguuccaggagaacgucuuccacaccauguggcacgugacccgcggggccgugcucauguaccagggcaagcggcuggagcccagcugggccuccgucaagaaggaccugaucagcuacggcgggggcuggcgccuccagggguccuggaacaccggcgaggagguccaggugaucgcggucgagcccgggaagaaccccaagaacgugcagacggcccccggcaccuucaagacccccgagggcgaggugggggccaucgcccuggacuucaagcccggcaccagcgggagccccaucgucaaccgggagggcaagaucgugggccuguacgggaacggcguggucacgaccuccgggaccuacgugagcgccaucgcgcaggccaaggccucccaggagggcccgcuccccgagaucgaggacgagguguuccgcaagcggaaccugaccaucauggaccugcaccccgggagcggcaagacgcgccgguaccucccggccaucguccgcgaggcgaucaagcggaagcugcgcacccugauccucgcccccacccgcgugguggccuccgagauggccgaggcccugaagggcaugcccauccgguaccagaccacggcggucaagagcgagcacaccgggcgcgagaucguggaccugaugugccacgccaccuucaccaugcggcuccugucccccgugcgcgucccgaacuacaacaugaucaucauggacgaggcccacuucacggaccccagcuccaucgccgcccggggcuacaucagcacccgcguggggaugggcgaggcggccgccaucuucaugaccgccacgccgcccggguccguggaggccuucccgcagagcaacgcggucauccaggacgaggagcgggacauccccgagcgcuccuggaacagcggcuacgaguggaucacggacuuccccggcaagaccgugugguucgugcccuccaucaagagcgggaacgacaucgccaacugccugcggaagaacggcaagcgcgucauccagcucucccggaagaccuucgacaccgaguaccagaagacgaagaacaacgacugggacuacguggugaccaccgacaucagcgagaugggggccaacuuccgcgccgaccgggucaucgacccgcgccggugccugaagcccgugauccugaaggacggccccgagcgcgucauccucgcggggcccaugccggugaccguggccuccgccgcccagcggcgcggccggaucggccgcaaccacaacaaggagggggaccaguacaucuacaugggccagccccugaacaacgacgaggaccacgcccacuggacggaggcgaagaugcugcucgacaacaucaacacccccgaggggaucauccccgcccuguucgagccggagcgcgagaaguccgccgccaucgacggcgaguaccggcugcgcggggaggcccggaagaccuucgucgagcucaugcgccggggcgaccugcccguguggcugagcuacaagguggcguccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcacguacuccgacccccucgcccugcgggaguucaaggaguucgccgccgggcgccggagcguguccggcgaccugauccucgagaucggcaagcugccgcagcaccugacccagcgcgcgcagaacgcccucgacaaccuggucaugcugcacaacagcgagcagggcgggcgggccuaccgccacgccauggaggagcuccccgacaccaucgagacccugaugcugcucgcgcugaucgccgugcugaccggcggggugacccucuucuuccuguccgggcgggggcugggcaagaccagcaucgggcuccugugcgucauggccuccagcgcccugcucuggaucgccuccguggagccccacuggaucgcggccagcaucauccuggaguucuuccugauggugcuccugauccccgagccggaccgccagcggacgccccaggacaaccagcuggccuacgucgugaucggccuccuguucaugauccugaccguggccgccaacgagauggggcuccuggagacgaccaagaaggaccugggcaucgggcacgucgcgguggagaaccaccaccacgccaccaugcucgacguggaccugcaccccgccuccgccuggacccuguacgccgucgcgacgaccaucaucaccccgaugaugcgccacaccaucgagaacacgaccgccaacaucagccucaccgccaucgccaaccaggccgcgauccugaugggccuggacaagggcuggcccaucuccaagauggacaucggggugccccuccuggcccugggcugcuacagccaggugaacccccucacccugacggccgccguccugaugcucguggcgcacuacgccaucaucgggccgggccugcaggccaaggccacccgcgaggcccagaagcggaccgcggccgggaucaugaagaaccccaccguggacggcaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacggggccccugaccacccucugggagggcuccccggggaaguucuggaacaccacgaucgccgucagcauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagagcgaguucaacaccuacaagcgguccggcaucauggagguggaccgcagcgaggccaaggaggggcugcggcgcggcgagacgaccaagcacgccgugucccgggggaccgcgaagcuccgcugguucgucgagcggaaccuggugaagcccgagggcaaggugaucgaccugggcugcgggcgcggcggguggagcuacuacugcgccggccugaagaaggucaccgaggugaagggguacacgaagggcggccccgggcacgaggagcccaucccgauggccaccuacggcuggaaccucgugaagcugcacuccgggaaggacgucuucuucaucccgcccgagaagugcgacacccugcucugcgacaucggcgagagcucccccaacccgaccaucgaggaggggcggacgcugcgcgugcugaagaugguggagcccuggcuccggggcaaccaguucugcaucaagauccugaaccccuacaugcccagcgucguggagacccuggagcagaugcagcgcaaguacggcgggaugcucgugcggaacccgcugucccgcaacagcacccacgagauguacugggucuccugcggcaccgggaacaucgugagcgccgugaacaugaccucccgcaugcugcucaaccgguucacgauggcccaccgcaagcccaccuacgagcgggacgucgaccugggcgcgggcacccgccacguggccguggagcccgaggucgccaaccuggacaucaucgggcagcggaucgagaacaucaagcacgagcacaagagcaccuggcacuacgacgaggacaaccccuacaagacgugggccuaccacggcuccuacgaggugaagccgagcgggagcgccuccagcauggucaacggcguggugaagcuccugaccaagcccugggacgucauccccauggugacccagaucgcgaugaccgacacgacccccuucgggcagcagcgcguguucaaggagaaggucgacacccggaccccgaaggccaagcgcggcacggcccagaucauggaggugaccgcccgguggcuguggggcuuccucucccgcaacaagaagccccggaucugcacccgcgaggaguucacccggaaggugcgcagcaacgccgcgaucggggccgucuucguggacgagaaccaguggaacuccgccaaggaggccguggaggacgagcgguucugggaccugguccaccgcgagcgggagcugcacaagcagggcaagugcgcgacgugcguguacaacaugauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgcggacgacaccgccgggugggacacccgcaucaccgaggacgaccugcagaacgaggccaagaucacggacaucauggagccggagcacgcccuccuggccaccuccaucuucaagcugaccuaccagaacaaggucgugcgggugcagcgccccgcgaagaacggcaccgucauggacgugaucagccggcgcgaccagcggggguccggccaggugggcacguacgggcucaacaccuucaccaacauggaggcccagcugauccgccagauggagagcgagggcaucuucucccccagcgagcuggagacccccaaccucgccgagcggguccuggacuggcuggagaaguacgggguggagcgccucaagcggauggccaucuccggcgacgacugcguggucaagccgaucgacgaccgcuucgccacggcgcugaccgcccugaacgacauggggaaggugcggaaggacaucccccagugggagcccagcaagggcuggaacgacuggcagcagguccccuucugcagccaccacuuccaccagcucaucaugaaggacggccgcgagaucgucgugccgugccggaaccaggacgagcugguggggcgcgcccgggucucccagggcgccggguggagccugcgcgagaccgccugccucggcaaguccuacgcgcagauguggcagcugauguacuuccaccggcgcgaccugcggcucgccgccaacgccaucugcagcgcggugcccguggacuggguccccaccucccgcacgaccuggagcauccacgcccaccaccaguggaugaccaccgaggacaugcuguccguguggaaccgcguguggaucgaggagaaccccuggauggaggacaagacgcacaucagcuccuggggcgacgucccguaccugggcaagcgggaggaccaguggugcggcagccucaucgggcugaccgcccgcgccaccugggccaccaacauccagguggcgaucaaccaggugcggcgccugaucggcaacgagaacuaccucgacuacaugaccuccaugaagcgguucaagaacgagagcgaccccgagggggcccugugguga

SEQ ID NO: 8779 - RNA, 9879 nt, Artificial Sequence
  derived and/or modified CDS sequence (opt1) from DENV-1__EU482511__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaugagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccaagcgcgugcuggacuggcucgagaaguacggcguggagcggcugaagcgcauggccaucuccggggacgacugcgucgugaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8780 - RNA, 9879 nt, Artificial Sequence
  derived and/or modified CDS sequence (opt1) from DENV-1__EU482513__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccgagcgcgugcuggacuggcucgagaaguacggcguggagcggcugaagcgcauggccaucuccggggacgacugcgucgugaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8781 - RNA, 9879 nt, Artificial Sequence
  derived and/or modified CDS sequence (opt1) from DENV-1__EU482515__SS-prME
agcgugaccacccugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggucaccuacgggaccugcagccagaccggcgagcaccggcgcgacaagcgguccguggcccucgcgccccacgugggccuggggcuggagacccgcaccgagacguggaugagcuccgagggcgccuggaagcagauccagcgggucgagaccugggcccuccgccaccccggguucaccgugaucgcccuguuccuggcccacgcgaucggcaccagcaucacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgccgugcugcggaagcucugcaucgaggcgaagaucuccaacacgaccaccgacagccgcugcccgacccagggcgaggccacgcugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugacgguccacaccggcgaccagcaccagguggggaacgaguccaccgagcacggcaccaccgccacgaucacgccccaggcgcccaccaccgagauccagcucacggacuacggggcccugacccuggacugcagcccccgcaccggccucgacuucaacgagaugguccugcugaccaugaaggagaaguccuggcucgugcacaagcagugguuccuggaccugccccuccccuggacgagcggggccagcaccucccaggagaccuggaaccggcaggaccugcuggugaccuucaagacggcccacgccaagaagcaggaggucguggugcucggcagccaggagggcgcgaugcacaccgcccugaccggggccaccgagauccagacguccggcaccaccaccaucuucgccgggcaccugaagugccgccucaagauggacaagcugacgcugaagggcaugagcuacgucaugugcaccggguccuucaagcucgagaaggagcuggccgagacccagcacggcaccgugcuggugcagaucaaguacgagggcacggacgcgcccugcaagauccccuucagcacccaggacgagaagggggucacccagaacggccggcugaucaccgccaacccgaucgugacggacaaggagaagcccgugaacaucgaggccgagccgcccuucggggaguccuacaucgucaucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagaucuucggcacggccuacggggugcuguucuccggcgugagcuggaccaugaagaucgggaucggcguccugcucaccuggcugggccugaacucccgcagcaccucccucagcaugacgugcaucgccguggggcuggugacccuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacgcgccucgagaacaucauguggaagcagaucuccaacgagcugaaccacauccugcucgagaacgacaugaaguucaccgucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagcuccgggacagcuacacccaggucugcgaccaccgccugauguccgcggccaucaaggacagcaaggccgugcacgccgacaugggcuacuggaucgaguccgagaagaacgagacguggaagcuggcccgggcgagcuucaucgaggugaagaccugcaucuggcccaagucccacacccucuggagcaacggcguccuggaguccgagaugaucauccccaagaucuacgggggcccgaugagccagcacaacuaccgccccggguacuucacccagacggccggccccuggcaccuggggaagcucgagcuggacuucgaccugugcgagggcaccaccgugguggucgacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcugguccaagaagaugcugaugacgggcacccuggccguguucuuccuccugaucauggggcagcugaccuggaacgaccucauccggcugugcaucauggugggcgccaacgcgagcgaccgcauggggaugggcaccacguaccuggcccucauggccaccuucaagaugcgcccgauguucgccgucggccugcuguuccggcgccucaccucccgggaggugcugcugcucaccaucgggcugagccugguggccuccgucgagcuccccaacagccuggaggagcugggcgacgggcucgcgaugggcaucaugauccugaagcugcucacggacuuccagucccaccagcugugggccacccugcucagccugaccuucaucaagaccacguucucccugcacuacgccuggaagaccauggccauggugcucagcaucgucucccuguucccccugugccucagcaccaccucccagaagacgaccuggcugcccgugcugcucggcagccuggggugcaagccgcugaccauguuccucaucgcggagaacaagaucuggggccgccgguccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgcgacgacacccucacgauccugcugaaggcgacccuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacacgauguggcacgugacccgcggcgccgugcugauguaccaggggaagcggcuggagcccagcugggcguccgucaagaaggaccucaucagcuacggcggcggguggcgccugcagggcuccuggaacaccggggaggagguccaggugaucgccgucgagcccggcaagaaccccaagaacgugcagaccgcccccgggacguucaagacccccgagggcgaggugggcgccaucgcccuggacuucaagcccgggaccagcggcucccccaucgucaaccgggaggggaagaucgugggccucuacggcaacgggguggucaccacgagcggcaccuacgugagcgcgaucgcccaggccaaggccucccaggaggggccgcugcccgagaucgaggacgagguguuccgcaagcggaaccugaccaucauggaccuccaccccggcagcgggaagacccgccgguaccugccggcgaucguccgcgaggccaucaagcggaagcugcgcacgcucauccuggcccccacccgcgugguggccuccgagauggccgaggcgcugaagggcaugcccauccgguaccagaccaccgccgucaagagcgagcacacgggcaaggagaucguggaccucaugugccacgccaccuucaccaugcgccugcugucccccgugcgggucccgaacuacaacaugaucaucauggacgaggcccacuucaccgaccccagcuccaucgccgcgcgcggguacaucagcacgcgggugggcaugggggaggccgccgccaucuucaugaccgccacgccgcccggcuccguggaggcguucccgcagagcaacgccgucauccaggacgaggagcgcgacauccccgagcgguccuggaacagcggguacgaguggaucaccgacuuccccggcaagacggugugguucgugcccuccaucaagagcggcaacgacaucgccaacugccuccgcaagaacgggaagcgggucauccagcugucccgcaagaccuucgacaccgaguaccagaagaccaagaacaacgacugggacuacguggugacgaccgacaucagcgagaugggcgccaacuuccgggcggaccgcgucaucgacccgcggcgcugccugaagcccgugauccucaaggacgggcccgagcgggugauccuggccggccccaugccggucaccguggccuccgccgcccagcgccgggggcgcaucggccggaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgcgagaaguccgccgccaucgacggggaguaccgccuccggggcgaggcgcgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacuccgacccccuggcccugcgcgaguucaaggaguucgccgcgggccggcgcagcguguccggggaccucauccuggagaucggcaagcugccgcagcaccucacgcagcgggcccagaacgcccuggacaaccuggucaugcuccacaacagcgagcagggcgggcgcgccuaccggcacgcgauggaggagcugcccgacaccaucgagacccugaugcuccuggcccugaucgccgugcucaccggcggggugacccuguucuuccuguccggccgcgggcucggcaagacgagcaucggccugcugugcgucauggccuccagcgugcuccuguggauggccuccguggagccccacuggaucgcggccagcaucauccuggaguucuuccucaugguccugcugauccccgagccggaccggcagcgcacgccccaggacaaccagcucgccuacguggugaucgggcugcuguucaugauccucaccgucgccgccaacgagaugggccugcuggagaccacgaagaaggaccucgggaucggccacguggcgguggagaaccaccaccacgccgccaugcuggacgucgaccugcaccccgccuccgccuggacccucuacgcgguggccaccaccaucaucacgccgaugaugcggcacaccaucgagaacaccaccgccaacaucagccugacggccaucgccaaccaggcggccauccugauggggcucgacaagggcuggcccaucuccaagauggacaucggcgugccccugcuggcccucgggugcuacagccaggucaacccccugacccugaccgccgcggugcucaugcugguggcccacuacgccaucaucggcccggggcugcaggccaaggccacccgcgaggcgcagaagcgcacggccgccggcaucaugaagaaccccaccgucgacgggaucguggccaucgaccucgaccccguggucuacgacgccaaguucgagaagcagcugggccagaucaugcugcucauccugugcaccucccagauccugcucaugcggaccacgugggcgcugugcgagagcaucacccuggccaccggcccccucaccacgcugugggagggguccccgggcaaguucuggaacaccaccaucgccgugagcauggccaacaucuuccgcggguccuaccuggccggcgcgggccucgccuucagccugaugaagucccucgggggcgggcggcgcgggaccggggcccagggcgagacgcucggcgagaaguggaagcggcagcugaaccagcuguccaagagcgaguucaacaccuacaagcgcuccgggaucauggagguggaccggagcgaggccaaggagggccucaagcgcggggagaccaccaagcacgcggucucccggggcacggccaagcugcgcugguucguggagcggaaccuggugaagcccgaggggaaggucaucgaccugggcugcggccgcgggggcuggagcuacuacugcgccgggcucaagaaggugaccgaggugaagggcuacaccaagggcggccccggccacgaggagcccaucccgauggccaccuacggguggaaccuggucaagcugcacuccggcaaggacguguucuucaucccgcccgagaagugcgacacgcuccugugcgacaucggggagagcucccccaacccgaccaucgaggagggccggacccugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggacgggcaacaucgugagcgccgucaacaugaccucccggaugcuccugaaccgcuucaccauggcgcaccgcaagcccaccuacgagcgggacguggaccugggggccggcacgcgccacguggccgucgagcccgagguggccaaccucgacaucaucggccagcggaucgagaacaucaagcacgagcacaagagcaccuggcacuacgacgaggacaaccccuacaagaccugggccuaccacggguccuacgaggugaagccgagcggcuccgcgagcagcauggucaacgggguggucaagcugcugaccaagcccugggacgugauccccauggugacgcagaucgccaugaccgacaccacccccuucggccagcagcgcgucuucaaggagaagguggacacgcggaccccgaaggccaagcgcgggaccgcccagaucauggaggugaccgccaaguggcucuggggcuuccugucccggaacaagaagccccgcaucugcacgcgggaggaguucacccgcaagguccggagcaacgcggccaucggcgccguguucguggacgagaaccaguggaacuccgccaaggaggcggucgaggacgagcgcuucugggaccuggugcaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccggggucgagggcgaggggcuccacaagcugggcuacauccugcgggacaucagcaagauccccgggggcaacauguacgccgacgacaccgccggcugggacacgcgcaucaccgaggacgaccuccagaacgaggcccggaucaccgacaucauggagccggagcacgcccugcuggcgaaguccaucuucaagcucaccuaccagaacaagguggugcgcguccagcgccccgccaagaacgggacggugauggacgugaucagccggcgcgaccagcggggcuccgggcaggucggcaccuacggccugaacaccuucaccaacauggaggcccagcugauccgccagauggagagcgaggggaucuucucccccagcgagcucgagacgcccaaccuggccaagcgggugcuggacuggcucgagaaguacggcguggagcgccugaagcggauggccaucuccggggacgacugcgucgugaagccgaucgacgaccgcuucgcgaccgcccugaccgcccucaacgacaugggcaaggugcggaaggacaucccccagugggagcccagcaagggguggaacgacuggcagcagguccccuucugcucccaccacuuccaccagcugaucaugaaggacggccgcgagaucguggugccgugccggaaccaggacgagcuggucggccgcgcccgggugagccagggggccggcuggagccuccgcgagaccgcgugccuggggaaguccuacgcccagauguggcagcugauguacuuccaccggcgcgaccuccggcuggccgccaacgcgaucugcagcgccgugcccgucgacuggauccccacgucccgcaccaccuggagcauccacgcccaccaccaguggaugaccacggaggacaugcuguccguguggaaccggguguggaucgaggagaaccccuggauggaggacaagacccacaucagcuccuggggcgacgucccguaccucgggaagcgcgaggaccaguggugcggcagccugaucggccugaccgcccgcgccaccugggcgaccaacauccagguggccaucaaccaggugcggcgccucaucgggaacgagaacuaccuggacuacaugacguccaugaagcgguucaagaacgagagcgaccccgagggcgcccugugguga

SEQ ID NO: 8782 - RNA, 9879 nt, Artificial Sequence
  derived and/or modified CDS sequence (opt1) from DENV-1__EU482516__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccacccugucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacgcuccuggccguguccggcguguacccgcugagcauccccgccacccucuucgucugguacuucuggcagaagaagaagcagcgcuccggggugcugugggacacccccagcccgcccgaggugggccgggccguccuggacgacggcaucuaccgcaucaugcagcgggggcugcucggccgcucccaggugggggugggcgucuuccaggagaacguguuccacaccauguggcacgugacgcgcggggccguccugauguaccagggcaagcgccuggagcccagcugggcguccgugaagaaggaccucaucagcuacggcgggggcuggcggcugcagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccucuacgggaacggcgucgugaccaccagcgggacguacgugagcgcgaucgcccaggccaaggccucccaggagggcccgcugcccgagaucgaggacgaggucuuccggaagcgcaaccugaccaucauggaccuccaccccgggagcggcaagacccggcgcuaccugccggcgaucgugcgggaggccaucaagcgcaagcugcgcacccucauccuggcccccacgcggguggucgccuccgagauggccgaggcgcugaagggcaugcccauccgcuaccagaccaccgccgucaagagcgagcacaccgggaaggagaucguggaccucaugugccacgccacguucaccaugcggcugcugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccuccggaagaacggcaagcgcgugauccagcugucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccucaaggacggccccgagcgcgucauccuggccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccaucgacggcgaguaccggcuccgcggggaggcgcggaagacguucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcaccuacuccgacccccuggcccugcgggaguucaaggaguucgccgcggggcgccggagcgucuccggcgaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacacgaucgagacccugaugcuccuggcccugaucgccgugcucaccgggggcgucacccuguucuuccuguccgggcggggccucggcaagaccagcaucgggcugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucggccugcuguucaugauccucaccguggccgccaacgagauggggcugcuggagaccaccaagaaggaccucggcaucgggcacguggcggucgagaaccaccaccacgccgccaugcuggacguggaccugcaccccgccuccgccuggacgcucuacgcgguggccaccaccaucaucaccccgaugaugcgccacacgaucgagaacaccaccgccaacaucagccugaccgccaucgccaaccaggcggccauccugaugggccucgacaagggcuggcccaucuccaagauggacaucggggucccccugcuggcccucggcugcuacagccaggugaacccccugacgcugaccgccgcggugcucaugcuggucgcccacuacgccaucaucgggccgggccugcaggccaaggccacccgcgaggcgcagaagcggaccgccgccgggaucaugaagaaccccacgguggacggcaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccgggccccucaccacccugugggagggcuccccggggaaguucuggaacacgaccaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagagcgaguucaacacguacaagcgguccggcaucauggaggucgaccgcagcgaggccaaggaggggcucaagcggggcgagaccaccaagcacgcggugucccgcgggaccgccaagcugcggugguucguggagcgcaaccuggucaagcccgagggcaaggugaucgaccugggcugcgggcggggcggguggagcuacuacugcgccggccucaagaaggugacggaggucaagggguacaccaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgacgaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgccgugaacaugacgucccgcaugcuccugaaccgcuucaccauggcgcaccggaagcccaccuacgagcgcgacguggaccugggcgccggcacccggcacgucgccguggagcccgagguggccaaccucgacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcucuggggcuuccugucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaacauccccggcggcaacauguacgccgacgacaccgccgggugggacacccggaucacggaggacgaccuccagaacgaggcccgcaucaccgacaucauggagccggagcacgcccugcuggcgaaguccaucuucaagcucaccuaccagaacaaggugguccgcgugcagcggcccgccaagaacggcaccgugauggacgucaucagccgccgggaccagcgcggguccggccaggugggcacguacgggcugaacaccuucaccaacauggaggcccagcugauccggcagauggagagcgagggcaucuucucccccagcgagcucgagacccccaaccuggccgagcgcgugcuggacuggcucgagaaguacggggucgagcggcugaagcgcauggccaucuccggcgacgacugcguggugaagccgaucgacgaccgguucgcgacggcccugaccgcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgccggguggagccuccgggagaccgcgugccugggcaaguccuacgcccagauguggcagcugauguacuuccaccgccgggaccuccgccuggccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucggcaagcgcgaggaccaguggugcggcagccugaucgggcugaccgcccgggccaccugggcgaccaacauccagguggccaucaaccagguccgccggcucaucggcaacgagaacuaccuggacuacaugaccuccaugaagcgcuucaagaacgagagcgaccccgagggggcccugugguga

SEQ ID NO: 8783 - RNA, 9879 nt, Artificial Sequence
  derived and/or modified CDS sequence (opt1) from DENV-1__EU482517__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaacaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccgcggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcgccacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcggaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggcgaaggagggccucaagcgcggggagaccaccaagcacgccgugucccgcggcaccgccaagcugcggugguucgucgagcgcaaccuggugaagcccgaggggaaggugaucgaccugggcugcggccgcgggggcuggagcuacuacugcgccgggcucaagaaggucacggaggugaagggcuacaccaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccgcacccugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugacgucccgcaugcuccugaaccgcuucaccauggcccaccggaagcccaccuacgagcgcgacgucgaccugggggccggcacccggcacguggccguggagcccgaggucgccaaccucgacaucaucggccagcgcaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcucuggggcuuccugucccgcaacaagaagccccggaucugcacccgcgaggaguucacgcggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcgcugcuggccaaguccaucuucaagcucaccuaccagaacaaggucgugcgcgugcagcggcccgccaagaacgggaccgucauggacgugaucagccgccgggaccagcgcggcuccggccagguggggacguacggccugaacaccuucaccaacauggaggcccagcugauccggcagauggacagcgaggggaucuucucccccagcgagcucgagacccccaaccuggccgagcgcguccuggacuggcucgagaaguacggcguggagcggcugaagcgcauggcgaucuccggggacgacugcguggucaagccgaucgacgaccgguucgccacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcuggugggccgggcccgcgucagccagggggcgggcuggagccuccgggagaccgccugccuggggaaguccuacgcccagauguggcagcugauguacuuccaccgccgggaccuccgccuggccgcgaacgccaucugcagcgccgugcccguggacuggauccccaccucccggacgaccuggagcauccacgcccaccaccaguggaugaccaccgaggacaugcuguccgucuggaaccgcguguggaucgaggagaaccccuggauggaggacaagacgcacaucagcuccuggggcgacgugccguaccucgggaagcgcgaggaccaguggugcggcagccugaucggccugaccgcccgggcgaccugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8784 - RNA, 9879 nt, Artificial Sequence
  derived and/or modified CDS sequence (opt1) from DENV-1__EU482519__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggggagcugugcgaggacaccaugaccuacaagugcccccggaucaccgaggccgagcccgacgacguggacugcuggugcaacgccaccgacaccugggugaccuacgggaccugcagccagacgggggagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugauggcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaaggugguccaguacgagaaccugaaguacuccgugaucgugaccguccacacgggcgaccagcaccagguggggaacgagagcaccgagcacggcaccaccgcgaccaucacgccccaggcccccaccuccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugauccagaacggccggcugaucacggccaacccgaucgugaccgacaaggagaagcccgucaacaucgaggccgagccgcccuucggggaguccuacaucgugaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcgucuucacgagcguggggaagcuggugcaccagaucuucggcaccgccuacgggguccucuucuccggcgugagcuggaccaugaagaucgggaucggcgugcugcugaccuggcucggccugaacucccgcagcacgucccugagcaugaccugcaucgccgucgggcucgugacccuguaccugggcgugaugguccaggccgacuccgggugcgugaucaacuggaagggccgggagcucaagugcgggagcggcaucuucgugaccaacgagguccacacguggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcccaggggaagaagaugauccggccccagcccauggagcacaaguacagcuggaaguccuggggcaaggcgaagaucaucggcgccgacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccuguggagcaacggcgugcucgaguccgagauggucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuucaagggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugaccuggaacgaccucacgcggcugugcaucauggugggcgccaacgcgagcgaccgcauggggaugggcaccaccuaccuggcccucauggccaccuucaagaugcgcccgauguucgccgucggccugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccauggugcugagcaucgucucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgugggcgucgugagcauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacccugcuggccguguccggcguguacccgcucagcauccccgccacgcuguucgucugguacuucuggcagaagaagaagcagcgcuccggggugcugugggacacccccagcccgcccgagguggagcgggccguccuggacgacggcaucuaccgcaucaugcagcggggccuccuggggcgcucccaggugggcgugggggucuuccaggagaacguguuccacaccauguggcacgugacccggggcgccguccugauguaccaggggaagcgccucgagcccagcugggcguccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccucgacuucaagcccgggacgagcggcucccccaucgugaaccgcgaggggaagaucgugggccuguacggcaacggggucgugaccaccagcggcaccuacgugagcgcgaucgcccaggccaaggccucccaggaggggccgcugcccgagaucgaggacgaggucuuccggaagcgcaaccucacgaucauggaccugcaccccggcagcgggaagacccggcgcuaccugccggcgaucgugcgggaggccaucaagcgcaagcuccggacccugauccuggcccccacccgcguggucgccuccgagauggccgaggcgcucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccucaagcccgucauccugaaggacgggcccgagcgcgugauccuggccggccccaugccggugacggucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccguguggcuguccuacaaggucgccagcgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagccggaccgccagcggacgccccaggacaaccagcuggccuacguggucaucgggcuccuguucaugauccugacgguggccgccaacgagaugggccugcucgagaccaccaagaaggaccuggggaucggccacguggcggucgagaaccaccaccacgccaccaugcuggacguggaccuccaccccgccuccgccuggacgcuguacgccguggcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgucccccugcucgcccuggggugcuacagccaggugaacccccugacgcucaccgccgccgugcugaugcuggucgcgcacuacgccaucaucggcccggggcuccaggccaaggccacccgggaggcccagaagcgcaccgcggccggcaucaugaagaaccccacgguggacgggaucguggccaucgaccuggaccccgucguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggaggucgaccgcagcgaggccaaggagggccugaagcgcggggagacgacccgccacgccgugucccggggcaccgcgaagcugcgcugguucguggagcggaaccuggucaagcccgaggggaaggugaucgaccucggcugcggccgcgggggcuggagcuacuacugcgccgggcugaagaaggugaccgaggucaagggcuacacgaagggcgggcccggccacgaggagcccaucccgauggccaccuacggguggaaccuggugaagcuccacuccggcaaggacguguucuucacgccgcccgagaagugcgacacccugcugugcgacaucggggagagcucccccaacccgacgaucgaggagggccggacccuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugacgucccggaugcugcugaaccgcuucaccauggcccaccgcaagcccaccuacgagcgggacguggaccucggggcgggcacccgccacgucgccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgccagcagcauggugaacggggucgugaagcugcucaccaagcccugggacgugauccccauggucacccagaucgcgaugacggacaccacccccuucggccagcagcgcguguucaaggagaagguggacacccggacgccgaaggccaagcgcgggaccgcccagaucauggaggucaccgcccgguggcuguggggcuuccugucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccucgugcagaaggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaaggugguccgggugcagcgccccgcgaagaacgggacggugauggacgucaucagccgccgggaccagcgcggcuccggccaggugggcaccuacggccugaacaccuucaccaacauggaggcccagcucauccggcagauggagagcgaggggaucuuccugcccuccgagcuggagacgcccaaccucgccgagcgcgugcuggacuggcuggagaagcacggcgucgagcggcucaagcgcauggccaucagcggggacgacugcguggugaagccgaucgacgaccgguucgccaccgcgcugaccgcccugaacgacaugggcaagguccgcaaggacaucccccagugggagcccuccaagggguggaacgacuggcagcagguccccuucugcagccaccacuuccaccagcucaucaugaaggacggccgggagaucguggucccgugccgcaaccaggacgagcuggugggccgggcccgcgugucccagggggccggcuggagccugcgggagaccgccugccucggcaagagcuacgcgcagauguggcagcugauguacuuccaccgccgggaccugcgccucgccgccaacgccaucugcuccgcgguccccguggacugggugcccacgagccggaccaccugguccauccacgcccaccaccaguggaugaccacggaggacaugcugagcgucuggaaccgcguguggaucgaggagaaccccuggauggaggacaagacccacguguccagcuggggcgacgucccguaccuggggaagcgggaggaccaguggugcggcucccucaucggccugaccgcccgcgccaccugggccagcaacauccagguggcgaucaaccaggugcgccggcugaucgggaacgagaacuaccucgacuacaugaccuccaugaagcgcuucaagaacgagggcgaccccgagggggcccugugguga

SEQ ID NO: 8785 - RNA, 9879 nt, Artificial Sequence
  derived and/or modified CDS sequence (opt1) from DENV-1__EU482520__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugcgggagaaguccuggcucgugcacaagcagugguuccuggaccugccccuccccuggaccagcggggccagcacgucccaggagaccuggaaccgccaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccgccugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccgccgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccggagcaccucccugagcaugaccugcaucgccguggggcucgucacgcuguaccugggcgugauggugcaggccgacuccgggugcgucaucaacuggaagggccgcgagcucaagugcgggagcggcaucuucgugaccaacgaggugcacaccuggaccgagcaguacaaguuccaggccgacagcccgaagcggcuguccgcggccaucggcaaggccugggaggagggggucugcggcauccgcagcgccacccggcuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacagcuggaaguccuggggcaaggccaagaucaucggcgccgacgugcagaacaccaccuucaucaucgacgggcccaacaccccggagugccccgacgaccagcgggccuggaacaucugggaggucgaggacuacggcuucgggaucuucacgaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagacgugcaucuggcccaagucccacacccuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcacgaccguggucguggacggccacugcgggaaccgcggcccgucccugcggaccaccacggugaccgggaagaucauccacgaguggugcugccgcagcugcacccugccgccccuccgguuccgcggcgaggacgggugcugguacggcauggagauccggcccgucaaggagaaggaggagaaccuggugaaguccauggugagcgccggcagcggggaggucgacuccuucagccucggccugcugugcaucuccaucaugaucgaggaggugaugcgcagccgguggucccgcaagaugcucaugaccgggauccuggccguguucuuccugcucaucaugggccagcugacguggaacgaccugauccgccucugcaucauggucggggccaacgcgagcgaccggaugggcaugggcaccaccuaccuggcccugauggccaccuucaagaugcgcccgauguucgccguggggcuccuguuccggcgccugacgucccgggaggugcuccugcugaccaucggccucagccuggucgccuccguggagcugcccaacagccucgaggagcugggggacggccuggcgaugggcaucaugauccucaagcugcugaccgacuuccagucccaccagcucugggccacccugcugagccucacguucaucaagaccaccuucucccugcacuacgccuggaagaccauggccaugguccugagcaucgugucccucuucccccugugccugagcacgaccucccagaagaccaccuggcuccccgugcugcuggggagccucggcugcaagccgcugacgauguuccugaucgcggagaacaagaucugggggcgccgguccuggccccucaacgagggcaucauggccgucgggaucgugagcauccugcugagcucccuccugaagaacgacgugccccuggccggcccccucaucgccggcgggaugcugaucgccugcuacgucaucagcggcuccagcgcggaccugucccucgagaaggccgccgaggugagcugggaggaggaggccgagcacuccggggccagccacaacauccugguggagguccaggacgacggcaccaugaagaucaaggacgaggagcgcgacgacacccugaccauccuccugaaggcgacccugcucgccguguccgggguguacccgcugagcauccccgccacgcuguucgucugguacuucuggcagaagaagaagcagcgguccggcgugcucugggacacccccagcccgcccgaggugggccgcgccguccuggacgacgggaucuaccggaucaugcagcgcggccugcuggggcggucccaggugggcgugggggucuuccaggagaacguguuccacaccauguggcacgugacccgcggcgccguccucauguaccagggcaagcggcuggagcccagcugggcguccgugaagaaggaccugaucagcuacgggggcggguggcgccuccagggcuccuggaacacgggggaggaggugcaggucaucgccguggagcccggcaagaaccccaagaacgugcagaccgcccccggcaccuucaagacccccgagggggaggucggcgccaucgcccuggacuucaagcccgggacgagcggcucccccaucgugaaccgggagggcaagaucguggggcuguacggcaacggggucgugaccaccagcggcaccuacgugagcgcgaucgcccaggccaaggccucccaggaggggccgcuccccgagaucgaggacgaggucuuccgcaagcggaaccugacgaucauggaccugcaccccggcagcggcaagacccgccgguaccucccggcgaucgugcgcgaggccaucaagcgcaagcugcggacccugauccucgcccccacccgcguggucgccuccgagauggccgaggcgcugaaggggaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgccgcgcgcggguacaucagcacccgggugggcaugggggaggccgccgccaucuucaugaccgccacgccgcccggcuccgucgaggcguucccgcagagcaacgccgugauccaggacgaggagcgcgacauccccgagcgguccuggaacagcggcuacgaguggaucaccgacuuccccgggaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgccaacuuccgggcggaccgcgugaucgacccgcggcgcugccugaagcccgugauccugaaggacgggcccgagcgggucauccucgccggccccaugccggugacggucgccuccgccgcccagcgccggggccgcaucgggcgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagaccuucguggagcucaugcggcgcggcgaccugcccguguggcuguccuacaaggucgccagcgagggguuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgccgcgggccggcgcagcgucuccggcgaccugauccucgagaucgggaagcugccgcagcaccugacccagcgggcccagaacgcccucgacaaccuggugaugcugcacaacagcgagcagggcgggcgcgccuaccggcacgcgauggaggagcuccccgacaccaucgagacgcugaugcugcucgcccugaucgccgugcugaccggcggggucacccucuucuuccuguccggccgcggccuggggaagaccagcaucggccuccugugcgugauggccuccagcgugcugcucuggauggccuccgucgagccccacuggaucgcggccagcaucauccuggaguucuuccugauggugcuccugauccccgagccggaccggcagcgcacgccccaggacaaccagcuggccuacguggucaucgggcuccuguucaugauccugacgguggccgccaacgagaugggccuccuggagaccaccaagaaggaccuggggaucggccacguggcggucgagaaccaccaccacgccgccaugcucgacguggaccugcaccccgccuccgccuggacccuguacgcgguggccacgaccaucaucaccccgaugaugcgccacaccaucgagaacacgaccgccaacaucagccucaccgccaucgccaaccaggcggccauccugaugggccuggacaagggguggcccaucuccaagauggacaucggcgucccccuccuggcccuggggugcuacagccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacggcaucguggccaucgaccuggaccccgucguguacgacgccaaguucgagaagcagcucgggcagaucaugcugcugauccucugcacgucccagauccugcugaugcggaccaccugggcgcucugcgagagcaucacccuggccacgggcccccugaccacccucugggagggguccccgggcaaguucuggaacaccacgaucgccgugagcauggccaacaucuuccgcggcuccuaccuggccggggcgggccuggccuucagccucaugaagucccucgggggcgggcggcgcggcaccggcgcccagggggagacccugggcgagaaguggaagcggcagcucaaccagcuguccaagagcgaguucaacaccuacaagcgcuccgggaucauggaggucgaccggagcgaggccaaggagggccugaagcgcggggagacgaccaagcacgcggugucccggggcaccgccaagcuccgcugguucguggagcggaaccuggucaagcccgagggcaaggugaucgaccuggggugcggccgcgggggcuggagcuacuacugcgccgggcugaagaaggugaccgaggucaagggcuacacgaagggcgggcccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccggggcaaccaguucugcaucaagauccugaaccccuacaugcccagcguggucgagacccuggagcagaugcagcgcaagcacgggggcaugcucgugcggaacccgcugucccgcaacagcacccacgagauguacuggguguccugcgggaccggcaacaucgucagcgccgugaacaugaccucccgcaugcugcucaaccgguucacgauggcgcaccgcaagcccaccuacgagcgggacguggaccugggcgccgggacccgccacgucgccguggagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgcgagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcggcacggcccagaucauggaggucaccgccaaguggcuguggggguuccucucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcugcacaagcaggggaagugcgccacgugcgucuacaacaugaugggcaagcgggagaagaagcucggggaguucggcaaggccaagggcagccgcgccaucugguacauguggcugggggcccgguuccuggaguucgaggcgcucggcuucaugaacgaggaccacugguucucccgcgagaacagccuguccgggguggagggcgaggggcugcacaagcucggcuacauccugcgggacaucagcaacauccccggcgggaacauguacgccgacgacaccgccggcugggacacccgcaucaccgaggacgaccugcagaacgaggcccgcaucacggacaucauggagccggagcacgcccuccuggcgaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggccaucuccggggacgacugcguggugaagccgaucgacgaccgcuucgcgaccgcccugacggcccugaacgacaugggcaagguccggaaggacaucccccagugggagcccagcaagggcuggaacgacuggcagcagguccccuucugcucccaccacuuccaccagcucaucaugaaggacgggcgcgagaucguggucccgugccggaaccaggacgagcuggugggccgcgcccgggugagccagggggccggcuggagccugcgcgagaccgcgugccucgggaaguccuacgcccagauguggcagcugauguacuuccaccggcgcgaccugcggcucgccgccaacgcgaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccugggcaagcgggaggaccaguggugcgggagccucaucggccugacggcccgcgccaccugggcgaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8786 - RNA, 9879 nt, Artificial Sequence
  derived and/or modified CDS sequence (opt1) from DENV-1__EU482521__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggccgcauguucgaggccaccgcccgcggggcccgccgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccggagcaccuccuucagcaugaccugcaucgccguggggcuggugacccucuaccugggcgucauggugcaggccgacuccgggugcgugaucaacuggaagggccgcgagcugaagugcgggagcggcaucuucgucacgaacgaggugcacaccuggaccgagcaguacaaguuccaggcggacagcccgaagcggcucuccgccgccaucggcaaggccugggaggagggggugugcggcauccgcagcgccacccggcuggagaacaucauguggaagcagaucuccaacgagcugaaccacauccuccuggagaacgacaugaaguucaccgucguggugggggacgucgcgggcauccuggcccaggggaagaagaugauccgcccccagcccauggaguacaaguacagcuggcgguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcucaagcugcgggacagcuacacccaggucugcgaccaccgccugauguccgccgccaucaaggacagcaaggccgugcacgccgacaugggcuacuggaucgaguccgagaagaacgagaccuggaagcucgcgcgggccagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccgcaagaugcugaugaccggcacccucgccguguuccugcugcucaucauggggcagcugacguggaacgaccugauccggcucugcaucauggugggcgcgaacgccagcgaccgcauggggaugggcaccaccuaccuggcccugauggccaccuucaagaugcggccgauguucgccgucgggcuccuguuccgccggcugacgucccgcgaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgggacgacacccugaccauccuccugaaggccacccugcucgccgucuccggcguguacccgcugagcauccccgccacgcuguucgugugguacaucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgcggugcucauguaccaggggaagcgccuggagcccagcugggccuccgucaagaaggaccugaucagcuacggcggcggguggcggcuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcuccccgagaucgaggacgagguguuccggaagcgcaaccugacgaucauggaccugcaccccggcagcgggaagacccggcgcuaccucccggccaucguccgcgaggccaucaagcggaagcugcgcacccugauccucgcccccacccgggugguggccuccgagauggcggaggcccugaagggcaugcccauccgcuaccagacgaccgccgucaagagcgagcacaccggcaaggagaucguggaccugaugugccacgccaccuucacgaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccugaaggacgggcccgagcgcgugauccucgccggccccaugccggucacgguggccuccgccgcgcagcggcgcgggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgccauggaggagcuccccgacaccaucgagacgcugaugcugcucgcccugaucgccgugcugaccggcggggugacccucuucuuccuguccggccgggggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcgcacgccccaggacaaccagcuggccuacguggugaucgggcuccuguucaugauccugacggucgccgcgaacgagaugggccuccuggagaccaccaagaaggaccuggggaucggccacguggccguggggaaccaccaccacgccgccaugcucgacgucgaccugcaccccgccuccgcguggacccuguacgccguggccacgaccaucaucaccccgaugaugcggcacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggccaaggcgacccgcgaggcccagaagcggaccgccgccgggaucaugaagaaccccaccgucgacggcaucguggccaucgaccuggaccccguggucuacgacgcgaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcaucauggagguggaccgcagcgaggcgaaggaggggcugaagcggggcgagaucacgaagcacgccgucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagcccaucccgauggccacguacggcuggaaccucgucaagcugcacuccgggaaggacguguucuucgugccgcccgagaagugcgacacccugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacgcuggagcagaugcagcggaagcacggcgggaugcucgugcgcaacccgcugucccgcaacagcacccacgagauguacuggguguccugcggcaccgggaacaucgucagcgcggugaacaugaccucccggaugcugcucaaccgcuucaccauggcccaccggaagcccacguacgagcgcgacguggaccugggcgccggcacccggcacgucgccguggagcccgagguggccaaccuggacaucaucgggcagcgcaucgagaacaucaagcacgagcacaagagcaccuggcacuacgacgaggacaaccccuacaagaccugggcguaccacggcuccuacgaggucaagccgagcggguccgccagcagcauggugaacggcgucgugaagcuccugacgaagcccugggacgugauccccauggucacccagaucgccaugaccgacaccacgcccuucgggcagcagcggguguucaaggagaagguggacacccgcaccccgaaggccaagcggggcaccgcccagaucauggaggucacggcgaaguggcuguggggcuuccucucccgcaacaagaagccccggaucugcacccgcgaggaguucacccggaaggugcgcagcaacgccgccaucggggccguguucgucgacgagaaccaguggaacuccgcgaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgccgacgacacggccgggugggacacccgcaucaccgaggacgaccugcagaacgaggcccggaucaccgacaucauggagccggagcacgcgcuccuggccaaguccaucuucaagcugacguaccagaacaaggugguccgcgugcagcggcccgccaagaacggcaccgugauggacgucaucagccgccgggaccagcgcggguccggccaggugggcaccuacgggcucaacaccuucacgaacauggaggcccagcugauccggcagauggagagcgagggcaucuucucccccagcgagcuggagacccccaaccucgccgagcgcgugcuggacuggcuggagaaguacggggucgagcggcucaagcgcauggcgaucuccggcgacgacugcguggugaagccgaucgacgaccgguucgccaccgcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgcgggguggagccugcgggagacggccugccucggcaaguccuacgcccagauguggcagcugauguacuuccaccgccgggaccugcgccucgccgcgaacgccaucugcagcgccguccccguggacuggauccccaccucccgcaccaccuggagcauccacgcccaccaccaguggaugacgaccgaggacaugcuguccguguggaaccgggucuggaucgaggagaaccccuggauggaggacaagacccacaucagcuccuggggcgacgugccguaccugggcaagcgcgaggaccaguggugcggcagccucaucgggcugaccgcccgggcgacgugggccaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8787 - RNA, 9879 nt, Artificial Sequence
  derived and/or modified CDS sequence (opt1) from DENV-1__EU482523__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggcgcaugcucaugaccggcacccuggccguguucuuccugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggaggucgaccggagcgaggcgaaggagggccugaagcgcggggagacgaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccggacgcugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgcggugaacaugaccucccgcaugcugcucaaccgguucacgauggcccaccgcaagcccaccuacgagcgggacguggaccugggggccggcacccgccacgucgccguggagcccgagguggccaaccuggacaucaucggccagcggaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcgcguguucaaggagaagguggacacccggaccccgaaggccaagcgcgggacggcccagaucauggaggucaccgcgaaguggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucaccgaggacgaccugcagaacgaggcccgcaucacggacaucauggagccggagcacgcgcuccuggccaaguccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8788 - RNA, 9879 nt, Artificial Sequence
  derived and/or modified CDS sequence (opt1) from DENV-1__EU482525__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccuccuucagcaugaccugcaucgccguggggcuggucacccucuaccugggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaagcugaccgugguggucggggacguggcgggcauccucgggcagggcaagaagaugauccggccccagcccauggaguacaaguacagcuggaaguccuggggcaaggccaagaucaucggggccgacgcccagaacacgaccuucaucaucgacggccccaacaccccggagugccccgacgaccagcgcgcguggaacaucugggagguggaggacuacggguucggcaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacggugguggucgacgagcacugcgggaaccggggcccgucccugcgcaccaccaccgugacggggaagaucauccacgaguggugcugccggagcugcacccugccgccccuccgcuuccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacccuggccguguucuuccugcucaucaugggccagcugacguggaacgaccugauccgccucugcaucauggugggggcgaacgccagcgaccgcaugggcaugggcaccaccuaccuggcccugauggccaccuucaagaugcggccgauguucgccgucgggcuccuguuccgccggcugacgucccgcgaggugcuccugcugaccaucggccucagccugguggcguccgucgagcugcccaacagccucgaggagcugggggacggccuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcuggggagccucggcugcaagccgcugacgauguuccugaucgccgagaacaagaucugggggcggaaguccuggccccucaacgagggcaucauggccguggggaucgucagcauccugcugagcucccuccugaagaacgacgugccccuggccggcccccucaucgccggcgggaugcugaucgcgugcuacgugaucagcggcuccagcgccgaccugucccucgagaaggccgccgaggucagcugggaggaggaggccgagcacuccggggcgagccacaacauccugguggaggugcaggacgacggcaccaugaagaucaaggacgaggagcgcgacgacacccugaccauccuccugaaggccacccugcucgccgucuccgggguguacccgcugagcauccccgccacgcuguucgugugguacuucuggcagaagaagaagcagcgguccggcguccucugggacacccccagcccgcccgagguggagcgcgccgugcuggacgacggcaucuaccggaucaugcagcgcgggcugcugggccggucccaggucggggugggcguguuccaggagaacgucuuccacaccauguggcacgugacccgcggggcggugcucauguaccagggcaagcggcuggagcccagcugggccuccgucaagaaggaccugaucagcuacggcgggggcuggcgccuccggggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccuguacgggaacggcguggucaccaccagcgggaccuacgugagcgccaucgcccaggccaaggcgucccaggagggcccgcuccccgagaucgaggacgagguguuccggaagcgcaaccugacgaucauggaccugcaccccgggagcggcaagacccggcgcuaccucccggccaucguccgggaggccaucaagcgcaagcugcgcacccugauccucgcccccacccgggugguggccuccgagauggcggaggcccugaagggcaugcccauccgcuaccagacgaccgccgucaagagcgagcacaccgggaaggagaucguggaccugaugugccacgccaccuucacgaugcggcuccugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccugaaggacggccccgagcgcgugauccucgccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcggucgacggcgaguaccggcugcgcggggaggcccggaagaccuucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggacgaaggagggcgagcggaagaagcugcgcccccgguggcuggacgcccgcaccuacuccgacccccucgcccugcgggaguucaaggaguucgcggccgggcgccggagcgucuccggcgaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccgugcugaccgggggcgucacccucuucuuccuguccgggcggggccugggcaagaccagcaucgggcuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggucccccuccuggcccugggcugcuacagccaggugaacccccucacccugacggcggccgugcugaugcucgucgcccacuacgccaucaucgggccgggccugcaggccaaggcgacccgcgaggcccagaagcggaccgccgccgggaucaugaagaaccccaccguggacggcaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcaucauggaggucgaccgcagcgaggcgaaggaggggcugaagcggggcgagacgaccaagcacgccgugucccgcgggaccgccaagcuccggugguucguggagcgcaaccuggucaagcccgagggcaaggugaucgaccugggcugcgggcggggcggguggagcuacuacugcgccggccugaagaaggugaccgaggucaagggguacacgaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgaccaucgaggaggggcgcacgcugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgcggugaacaugaccucccgcaugcugcucaaccgcuucacgauggcccaccggaagcccaccuacgagcgcgacguggaccugggcaccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcccgcuggcuguggggcuuccucucccggaacaagaagccccgcaucugcacccgggaggaguucacgcgcaaggugcggagcaacgcggccaucggggccguguucgucgacgagaaccaguggaacuccgccaaggaggcgguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcguggagggggagggccugcacaagcucggguacauccugcgggacaucagcaagauccccggcggcaacauguacgccgacgacaccgccgggugggacacccgcaucacggaggacgaccugcagaacgaggccaagaucaccgacaucauggagccggagcacgcccuccuggcgaaggccaucuucaagcugaccuaccagaacaaggugguccgcgugcagcggcccgccaagaacggcaccgugauggacgucaucucccgccgggaccagcgcgggagcggccaggugggcacguacgggcucaacaccuucaccaacauggaggcccagcugauccggcagauggaguccgagggcaucuucagccccuccgagcuggagacccccaaccucgccgagcgcgcgcuggacuggcuggagaaguacgggaucgagcggcucaagcgcauggccaucagcggcgacgacugcguggucaagccgaucgacgaccgguucgccacggcccugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcgcgcgucucccagggcgccggguggagccugcgggagaccgccugccucggcaagagcuacgcccagauguggcagcugauguacuuccaccgccgggaccugcgccucgcggccaacgccaucugcuccgccgugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcugggaggacgucccguaccuggggaagcgcgaggaccaguggugcggcucccucaucggccugaccgcgcgggccaccugggccaccaacauccagguggccaucaaccaggugcgccggcugaucgggaacgagaacuaccucgacuacaugaccagcaugaagcgcuucaagaacgagacggaccccgagggcgcccugugguga

SEQ ID NO: 8789 - RNA, 9879 nt, Artificial Sequence
  derived and/or modified CDS sequence (opt1) from DENV-1__EU482526__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccggcugugcaucauggucggcgccaacgcgagcgaccgcauggggaugggcaccaccuaccuggcccucauggccaccuucaagaugcgcccgauguucgccguggggcugcuguuccggcgccucacgucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccacccugucccuccacuacgccuggaagaccauggccaugguccugagcaucgugucccuguucccccucugccugagcacgaccucccagaagaccaccuggcugcccgugcuccugggcagccuggggugcaagccgcucacgauguuccugaucgcggagaacaagaucuggggccgcaaguccuggccccugaacgaggggaucauggccgucggcguggugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggcguccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcccucgacuucaagcccgggacgagcggcucccccaucgugaaccgcgaggggaagaucgucggccuguacggcaacgggguggugaccaccagcggcaccuacgucagcgcgaucgcccaggccaaggccucccaggaggggccgcugcccgagaucgaggacgagguguuccggaagcgcaaccucacgaucauggaccugcaccccggcagcgggaagacccggcgcuaccugccggcgaucgugcgggaggccaucaagcgcaagcuccggacccugauccuggcccccacccgcgucguggccuccgagauggccgaggcgcucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugaccgccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgcggaccgggugaucgacccgcgccggugccucaagcccgucauccugaaggacgggcccgagcgcgugauccuggccggccccaugccggucacgguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgggagaaguccgccgccaucgacggggaguaccgccugcgcggcgaggcgcggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugacgguggccgccaacgagaugggccugcucgagaccaccaagaaggaccuggggaucggccacgucgcgguggagaaccaccaccacgccaccaugcuggacguggaccuccaccccgccuccgccuggacgcuguacgccgucgcgaccaccaucaucaccccgaugaugcgccacacgaucgagaacaccaccgccaacaucagccugaccgccaucgccaaccaggccgcgauccucauggggcuggacaagggcuggcccaucuccaagauggacaucggcgugccccugcucgcccuggggugcuacagccaggugaacccccugacgcucaccgccgccguccugaugcugguggcgcacuacgccaucaucggcccggggcuccaggccaaggccacccgggaggcccagaagcgcaccgcggccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccggcccccugaccacccugugggagggguccccgggcaaguucuggaacacgaccaucgccgucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagacgacccgccacgccgugucccggggcaccgcgaagcugcgcugguucgucgagcggaaccuggugaagcccgaggggaaggugaucgaccucggcugcggccgcgggggcuggagcuacuacugcgccgggcugaagaaggucaccgaggugaagggcuacacgaagggcgggcccggccacgaggagcccaucccgauggccaccuacggguggaaccuggugaagcuccacuccggcaaggacgucuucuucacgccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgccgugaacaugacgucccggaugcugcugaaccgcuucaccauggcccaccgcaagcccaccuacgagcgggacgucgaccucggggcgggcacccgccacguggccguggagcccgaggucgccaaccuggacaucaucggccagcggaucgagaacaucaagcacgagcacaagagcacguggcacuacgacgaggacaaccccuacaagaccugggccuaccacggguccuacgaggugaagccgagcggcuccgccagcagcauggucaacgggguggugaagcugcucaccaagcccugggacgucauccccauggugacccagaucgcgaugacggacaccacccccuucggccagcagcgcguguucaaggagaaggucgacacccggacgccgaaggccaagcgcgggaccgcccagaucauggaggugaccgcccgguggcuguggggcuuccugucccgcaacaagaagccccggaucugcacccgcgaggaguucacgcggaaggugcgcagcaacgccgcgaucggcgccgucuucguggacgagaaccaguggaacuccgccaaggaggccguggaggacgagcgguucugggaccucguccagaaggagcgcgagcugcacaagcaggggaagugcgcgaccugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccgggguggagggcgaggggcugcacaagcugggcuacauccuccgggacaucagcaagauccccgggggcaacauguacgcggacgacaccgccggcugggacacccgcaucacggaggacgaccugcagaacgaggccaagaucaccgacaucauggagccggagcacgcccugcucgccaccuccaucuucaagcugaccuaccagaacaaggucgugcgggugcagcgccccgcgaagaacgggacggucauggacgugaucagccgccgggaccagcgcggcuccggccaggugggcaccuacggccugaacaccuucaccaacauggaggcccagcucauccggcagauggagagcgaggggaucuucucccccagcgagcuggagauccccaaccuggccgagcgcguccucgacuggcuggagaaguacggcguggagcggcugaagcgcauggccaucuccggggacgacugcguggucaagccgaucgacgaccgguucgccacggcgcucaccgcccugaacgacaugggcaaggugcgcaaggacgugccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgccugccuggggaaguccuacgcgcagauguggcagcucauguacuuccaccgccgggaccugcgccuggccgccaacgccaucugcagcgcggugcccgucgacugggugcccaccucccggacgaccuggagcauccacgcccaccaccaguggaugaccaccgaggacaugcucuccguguggaaccgcgucuggaucgaggagaaccccuggauggaggacaagacgcacgugagcuccuggggcgacgugccguaccuggggaagcgggaggaccaguggugcggcagccugaucggccucaccgcccgcgccaccugggccuccaacauccaggucgcgaucaaccaggugcgccggcugaucgggaacgagaacuaccuggacuacaugaccagcaugaagcgcuucaagaacgagggcgaccccgagggggcccucugguga

SEQ ID NO: 8790 - RNA, 9879 nt, Artificial Sequence
  derived and/or modified CDS sequence (opt1) from DENV-1__EU482527__SS-prME
agcgugaccaugcugcucaugcugaugcccaccgcccuggccuuccaccucaccacccgcggcggggagccccacaugaucgugagcaagcaggagcggggcaagagccugcuguucaagaccuccgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgggaagggcgugacccagaacgggcggcugaucacggccaacccgaucgugaccgacaaggagaagcccgucaacaucgaggccgagccgcccuucggcgagagcuacaucgugaucggcgcgggggagaaggcccugaagcuguccugguucaagaagggcagcuccaucgggaagauguucgaggccaccgcccgcggcgcccggcgcauggcgauccucggggacaccgccugggacuucggcagcaucggcgggguguucacguccgucggcaagcuggugcaccagaucuucgggaccgccuacggcgugcuguucagcggggucuccuggaccaugaagaucggcaucggcgugcuccugaccuggcuggggcucaacagccgcuccacgagccuguccaugaccugcaucgccgugggccuggucacccucuaccugggggugauggugcaggccgacagcggcugcgucaucaacuggaaggggcgggagcugaagugcggcagcggcaucuucgugaccaacgaggugcacacguggaccgagcaguacaaguuccaggcggacuccccgaagcgccucagcgccgccaucgggaaggccugggaggagggcgucugcgggauccgguccgccacccgccuggagaacaucauguggaagcagaucagcaacgagcugaaccacauccuccuggagaacgacaugaaguucaccgugguggucggcgacguggcggggauccuggcccagggcaagaagaugauccggccccagcccauggaguacaaguacuccuggaaguccuggggcaaggccaagaucaucggggccgacgugcagaacaccacguucaucaucgacggccccaacaccccggagugccccgacgaccagcgcgcguggaacaucugggaggucgaggacuacggguucggcaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggggugcuggagagcgagaugaucauccccaagaucuacggcgggccgaucucccagcacaacuaccgccccggcuacuucacgcagaccgccgggcccuggcaccucggcaagcuggagcuggacuucgaccucugcgagggcaccaccguggucguggacgagcacugcgggaaccggggcccgagccugcgcacgaccaccgugaccgggaagaucauccacgaguggugcugccgguccugcacgcugccgccccugcgcuucaagggcgaggacgggugcugguacggcauggagauccggcccgucaaggagaaggaggagaaccuggucaagagcauggugagcgccggcuccggggaggucgacagcuucucccugggccuccugugcaucagcaucaugaucgaggaggugaugcgcucccgguggagccgcaagaugcugaugaccgggacccucgccguguucuuccugcugaucaugggccagcucaccuggaacgaccugauccggcugugcaucauggucggggcgaacgccuccgaccgcaugggcaugggcacgaccuaccucgcccugauggccaccuucaagaugcgcccgauguucgccguggggcuccuguuccggcgccugaccagccgggaggugcugcuccugacgaucggccugucccucgucgcguucguggagcugcccaacagccuggaggagcucggggacggccuggccaugggcaucaugauccugaagcuccugaccgacuuccagucccaccagcugugggccacccuccugagccugaccuucaucaagacgaccuucucccuccacuacgccuggaagaccauggcgaugguccugagcaucgugucccuguucccccucugccugagcaccacgucccagaagaccaccuggcugcccgugcuccuggggagccugggcugcaagccgcucaccauguuccugaucgccgagaacaagaucugggggcgcaaguccuggccccugaacgagggcaucauggccgucgggaucgugagcauccuccugagcucccugcucaagaacgacgugccccuggccggcccccugaucgccggcgggaugcucaucgcgugcuacgucaucagcggcuccagcgccgaccugucccuggagaaggccgccgaggugagcugggaggaggaggccgagcacuccggggcgagccacaacauccucguggagguccaggacgacggcacgaugaagaucaaggacgaggagcgggacgacacccugaccauccugcucaaggccacccugcuggccguguccgggguguacccgcucagcauccccgccacccuguucgucugguacuucuggcagaagaagaagcagcgcuccggcgugcugugggacacgcccagcccgcccgagguggagcgggccguccucgacgacggcaucuaccgcaucaugcagcgggggcugcugggccgcucccaggugggggugggcgucuuccaggagaacguguuccacaccauguggcacgugacccgcggggccguccugauguaccagggcaagcgccucgagcccagcugggccuccgugaagaaggaccugaucagcuacggcgggggcuggcggcugcagggguccuggaacaccggcgaggaggugcaggucaucgccguggagcccgggaagaaccccaagaacgugcagacggcccccggcaccuucaagaccagcgagggcgaggucggggccaucgcgcucgacuucaagcccggcaccuccgggagccccaucgugaaccgcgagggcaagaucgugggccuguacgggaacggcgucgugacgaccagcgggaccuacguguccgccaucgcccaggccaaggcgagccaggagggcccccugccggagaucgaggacgaggucuuccggaagcgcaaccucaccaucauggaccugcaccccggguccggcaagacgcggcgcuaccugcccgccaucgugcgggaggccaucaagcgcaagcuccggacccugauccuggccccgacccgcguggucgccagcgagauggcggaggcccucaagggcaugcccauccgcuaccagaccacggccgugaaguccgagcacaccgggaaggagaucguggaccugaugugccacgccaccuucaccaugcggcugcucagccccguccgcgugcccaacuacaacaugaucaucauggacgaggcccacuucacggacccguccagcaucgcggcccggggcuacaucuccacccgcguggggaugggcgaggccgccgccaucuucaugaccgcgacgccgcccgggagcgucgaggccuucccccaguccaacgccgugauccaggacgaggagcgggacaucccggagcgcagcuggaacuccggcuacgaguggaucacggacuuccccggcaagaccgugugguucguccccagcaucaaguccgggaacgacaucgccaacugccugcggaagaacggcaagcgcgugauccagcugagccggaagaccuucgacaccgaguaccagaagacgaagaacaacgacugggacuacguggucaccaccgacaucuccgagaugggggcgaacuuccgcgccgaccgggugaucgacccccgccggugccucaagccggugauccugaaggacggccccgagcgcgucauccuggccgggcccaugcccgugaccgucgccagcgccgcgcagcggcgcggccggaucggccgcaaccacaacaaggagggggaccaguacaucuacaugggccagccgcucaacaacgacgaggaccacgcccacuggacggaggccaagaugcugcuggacaacaucaacacccccgaggggaucauccccgcccucuucgagcccgagcgggagaaguccgccgcgaucgacggcgaguaccgccugcgcggggaggcccggaagaccuucguggagcugaugcgccggggcgaccucccgguguggcugagcuacaaggucgccagcgagggcuuccaguacuccgaccgccgguggugcuucgacggggagcgcaacaaccaggugcuggaggagaacauggacguggagaucuggaccaaggagggcgagcggaagaagcuccgcccccgguggcuggacgcccgcacguacagcgacccccuggcccuccgggaguucaaggaguucgcggccgggcgccgguccgucagcggcgaccugauccuggagaucggcaagcucccccagcaccugacccagcgcgcccagaacgcccuggacaaccucgugaugcugcacaacuccgagcagggcgggcgggcguaccgccacgccauggaggagcugccggacaccaucgagacccucaugcugcuggcccucaucgccgugcugacgggcggggucacccuguucuuccucagcgggcgggggcugggcaagaccuccaucgggcugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucggccuccucuucaugauccugaccguggccgcgaacgagauggggcugcucgagacgaccaagaaggaccugggcaucgggcacguggccgucgagaaccaccaccacgccgccaugcuggacguggaccuccaccccgccagcgcguggacccuguacgccguggccaccacgaucaucacccccaugaugcgccacaccaucgagaacaccacggccaacaucucccugaccgccaucgcgaaccaggccgccauccucaugggccuggacaagggcuggccgaucagcaagauggacaucggggucccccugcucgcccugggcugcuacucccaggugaacccccugacccucaccgcggccgugcugaugcuggucgcccacuacgccaucaucgggcccggccuccaggccaaggcgacgcgggaggcccagaagcgcaccgccgccgggaucaugaagaacccgaccguggacggcaucguggccaucgaccuggaccccgucguguacgacgcgaaguucgagaagcagcugggccagaucaugcuccugauccugugcaccagccagauccuccugaugcgcacgaccugggcccugugcgaguccaucacccucgccaccgggccccugacgacccugugggagggcagccccgggaaguucuggaacaccaccaucgccguguccauggccaacaucuuccggggcagcuaccucgcgggcgccgggcuggccuucagccugaugaagucccucggcgggggccgccgggggacgggcgcccagggcgagacccugggggagaaguggaagcgccagcugaaccagcucagcaaguccgaguucaacaccuacaagcggagcggcaucauggaggucgaccgcuccgaggcgaaggaggggcugaagcggggcgagaccacgaagcacgccgugagccgcgggaccgccaagcugcggugguucguggagcgcaaccucgucaagccggagggcaaggugaucgaccugggcugcgggcggggcgggugguccuacuacugcgccggccugaagaaggugaccgaggucaagggguacaccaagggcggccccgggcacgaggagcccauccccauggccacguacggcuggaaccuggugaagcuccacagcgggaaggacguguucuucaucccgcccgagaagugcgacacccugcugugcgacaucggcgaguccagccccaaccccaccaucgaggaggggcgcacccuccggguccugaagaugguggagccguggcugcgcggcaaccaguucugcaucaagauccucaaccccuacaugcccuccguggucgagacgcuggagcagaugcagcggaagcacggcgggaugcuggugcgcaacccccucagccggaacuccacccacgagauguacugggugagcugcggcaccgggaacaucgucuccgcggugaacaugaccagccgcaugcugcugaaccgguucaccauggcccaccgcaagccgacguacgagcgcgacguggaccucggcgccggcacccggcacgucgccguggagcccgagguggccaaccuggacaucaucgggcagcgcaucgagaacaucaagcacgagcacaaguccaccuggcacuacgacgaggacaaccccuacaagaccugggcguaccacggcagcuacgaggucaagcccuccgggagcgccagcuccauggugaacggcgucgugaagcugcucacgaagccgugggacgugauccccauggucacccagaucgccaugaccgacaccacgcccuucgggcagcagcggguguucaaggagaagguggacacccgcacccccaaggccaagcggggcaccgcccagaucauggaggucacggcgaaguggcuguggggcuuccugagccgcaacaagaagccgcggaucugcacccgcgaggaguucacccggaaggugcgcuccaacgccgccaucggggccguguucgucgacgagaaccaguggaacagcgcgaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcucccgggccaucugguacauguggcucggcgcgcgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacacggccgggugggacacccggaucaccgaggacgaccugcagaacgaggccaagaucaccgacaucauggagcccgagcacgcgcugcucgccaagagcaucuucaagcugacguaccagaacaaggugguccgcgugcagcggccggccaagaacggcaccgugauggacgucaucucccgccgcgaccagcgggggagcggccaggugggcaccuacgggcugaacaccuucacgaacauggaggcccagcucauccgccagauggaguccgagggcaucuucagccccuccgagcuggagacccccaaccuggccgggcgggugcucgacuggcuggagaagcacggcgucgagcgccugaagcggauggcgaucagcggggacgacugcguggugaagcccaucgacgaccgcuucgccaccgcccucaccgcccugaacgacaugggcaagguccggaaggacaucccgcagugggagcccuccaagggcuggaacgacuggcagcagguccccuucugcagccaccacuuccaccagcugaucaugaaggacgggcgcgagaucgugguccccugccggaaccaggacgagcucgugggccgcgcccgggugagccagggggcgggcuggucccugcgcgagacggccugccugggcaagagcuacgcccagauguggcagcucauguacuuccaccggcgcgaccugcggcuggccgcgaacgccaucugcuccgccgucccgguggacugggugcccaccagccgcaccaccugguccauccacgcccaccaccaguggaugacgaccgaggacaugcucagcgucuggaaccggguguggaucgaggagaaccccuggauggaggacaagacccacaucuccagcuggggcgacgugcccuaccugggcaagcgcgaggaccaguggugcgggucccugaucggccucaccgcccgggcgacgugggccaccaacauccaggucgccaucaaccaggugcgccgccugaucgggaacgagaacuaccuggacuacaugaccagcaugaagcgguucaagaacgaguccgacccggagggcgcccucugguga

SEQ ID NO: 8791 - RNA, 9879 nt, Artificial Sequence
  derived and/or modified CDS sequence (opt1) from DENV-1__EU482528__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcauguccuacgucaugugcaccgggagcuucaagcuggagaaggagguggcggagacgcagcacggcaccgugcucguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccgucgggaagcuggugcaccagaucuucggcaccgccuacggggugcuguucagcggcgucuccuggaccaugaagaucgggaucggcgugcuccugacguggcugggccucaacagccgcuccaccagccuguccaugaccugcaucgccguggggcuggucacccucuaccugggcgccauggugcaggcggacagcgggugcgugaucaacuggaagggccgggagcugaagugcgggagcggcaucuucgucacgaacgaggugcacaccuggaccgagcaguacaaguuccaggccgacuccccgaagcgccucagcgccgccaucggcaaggccugggaggagggggugugcggcauccgguccgcgacccgccuggagaacaucauguggaagcagaucagcaacgagcugaaccacauccuccuggagaacgacaugaaguucaccgucguggugggggacgucgccggcauccuggcccaggggaagaagaugauccggccccagcccauggaguacaagcacuccuggaaguccuggggcaaggccaagaucaucggcgcggacgugcagaacacgaccuucaucaucgacgggcccaacaccccggagugccccgacgaccagcgcgccuggaacaucugggagguggaggacuacggcuucgggaucuucaccacgaacaucuggcucaagcugcgggacuccuacacccaggucugcgaccaccgccugaugagcgccgccaucaaggacuccaaggccgugcacgcggacaugggcuacuggaucgagagcgagaagaacgagaccuggaagcucgcccgggccuccuucaucgaggugaagaccugcaucuggcccaagagccacacgcugugguccaacggcguccuggagagcgagaugaucauccccaagaucuacgggggcccgaucucccagcacaacuaccgccccggguacuucacccagaccgccggccccuggcaccucgggaagcuggagcuggacuucgaccucugcgagggcaccacggugguggucgacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgugaaggagaaggaggagaaccuggucaagagcauggugagcgccggcuccggcgagguggacagcuucucccuggggcuccugugcaucagcaucaugaucgaggaggucaugcgcucccgguggagccgcaagaugcugaugaccggcacccucgcgguguucuuccugcugaucauggggcagcucacguggaacgaccugauccggcugugcaucauggugggcgccaacgccuccgaccgcauggggaugggcaccaccuaccucgcccugauggccaccuucaagaugcgcccgauguucgcggucggccuccuguuccggcgccugacgagccgggaggugcugcuccugaccaucgggcugucccucguggccagcgucgagcugcccaacucccuggaggagcucggcgacgggcuggccaugggcaucaugauccugaagcuccugaccgacuuccagagccaccagcugugggccacccuccugucccugacguucaucaagaccaccuucagccuccacuacgcguggaagaccauggccauggugcuguccaucgucagccuguucccccucugccuguccacgaccagccagaagaccaccuggcugcccgugcuccugggcucccuggggugcaagccgcucacgauguuccugaucgccgagaacaagaucuggggccgcaagagcuggccccugaacgaggggaucauggccgugggcaucgucagcauccuccuguccagccugcucaagaacgacgugccccuggccgggccccugaucgcgggcggcaugcucaucgccugcuacgugaucuccgggagcuccgccgaccugagccuggagaaggccgccgaggucuccugggaggaggaggcggagcacagcggcgccucccacaacauccucguggaggugcaggacgacgggaccaugaagaucaaggacgaggagcgggacgacacccugaccauccugcucaaggccacccugcuggccgucagcggcguguacccgcucuccauccccgccacgcuguucgugugguacuucuggcagaagaagaagcagcgcagcgggguccugugggacacccccagcccgcccgagguggagcgggcggugcucgacgacggcaucuaccgcaucaugcagcggggccugcuggggcgcagccaggucggcguggggguguuccaggagaacgucuuccacaccauguggcacgugacccggggcgccgugcugauguaccaggggaagcgccucgagcccuccugggccagcgucaagaaggaccugaucuccuacggcggcggguggcggcugcagggcagcuggaacacgggggaggagguccaggugaucgccgucgagcccggcaagaaccccaagaacgugcagaccgcccccgggaccuucaagaccuccgagggcgaggugggcgcgaucgcccucgacuucaagcccgggacgagcggcagccccaucgucaaccgcgaggggaagaucgugggccuguacggcaacgggguggucaccaccuccggcaccuacgugagcgccaucgcccaggcgaaggccucccaggaggggccccugccggagaucgaggacgagguguuccggaagcgcaaccucacgaucauggaccugcaccccggcagcgggaagacccggcgcuaccugcccgccaucguccgggaggccaucaagcgcaagcuccggacccugauccuggccccgacccgcgugguggcguccgagauggccgaggcccucaagggcaugcccauccgcuaccagacgaccgccgucaagagcgagcacaccggcaaggagaucguggaccugaugugccacgccaccuucacgaugcggcugcucucccccgugcgcguccccaacuacaacaugaucaucauggacgaggcgcacuucaccgacccgagcuccaucgccgcccggggguacaucagcacccgcgugggcaugggggaggccgccgcgaucuucaugaccgccacgccgcccggcuccguggaggccuucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgcgaacugccugcggaagaacgggaagcgcgucauccagcugucccggaagaccuucgacacggaguaccagaagaccaagaacaacgacugggacuacguggugaccaccgacaucagcgagaugggcgccaacuuccgcgccgaccgggucaucgacccccgccggugccucaagccggugauccugaaggacgggcccgagcgcgugauccuggccggccccaugcccgucacgguggccuccgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgcggccaucgacggggaguaccgccugcgcggcgaggcccggaagaccuucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggacgaaggagggggagcggaagaagcuccgcccccgguggcuggacgcccgcaccuacuccgacccccuggcgcuccgggaguucaaggaguucgccgccggccgccggagcguguccggggaccugauccuggagaucggcaagcucccccagcaccugacccagcgcgcccagaacgcgcuggacaaccucgucaugcugcacaacagcgagcagggcgggcgggccuaccgccacgccauggaggagcugccggacaccaucgagacgcucaugcugcuggcccucaucgccgugcugaccggcggggugacccuguucuuccucuccggccgggggcugggcaagaccagcaucggccugcucugcgucauggcguccagcgugcugcuguggauggccuccguggagccccacuggaucgccgccagcaucauccucgaguucuuccugaugguccugcucauccccgagcccgaccgccagcggaccccgcaggacaaccagcuggccuacguggugaucgggcuccucuucaugauccugacggucgcggccaacgagaugggccugcucgagaccaccaagaaggaccuggggaucggccacguggccguggagaaccaccaccacgccgccaugcuggacgucgaccuccaccccgcguccgccuggacccuguacgccguggccacgaccaucaucacccccaugaugcgccacaccaucgagaacacgaccgccaacaucagccugaccgcgaucgccaaccaggccgccauccucauggggcuggacaagggcuggccgaucuccaagauggacaucggcgugccccugcucgcgcuggggugcuacagccaggucaacccccugacccucacggccgccgugcugaugcugguggcccacuacgccaucaucggccccgggcuccaggcgaaggccacccgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggcgaacaucuuccgggggagcuaccucgccggcgccggccuggccuucucccugaugaagucccucgggggcgggcgccggggcaccggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcggccccggccacgaggagcccauccccauggcgaccuacggguggaaccuggucaagcuccacuccggcaaggacguguucuucaucccgcccgagaagugcgacacccugcugugcgacaucggggagagcucccccaaccccaccaucgaggagggccgcacgcuccgggugcugaagauggucgagccguggcugcgcgggaaccaguucugcaucaagauccucaaccccuacaugcccagcgugguggagacccuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucacgauggcccaccgcaagccgaccuacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagacgugggccuaccacggguccuacgaggugaagcccagcggcagcgccuccagcauggucaacgggguggucaagcugcucaccaagccgugggacgugauccccauggugacccagaucgccaugaccgacacgacccccuucggccagcagcgggucuucaaggagaagguggacacccgcacccccaaggccaagcgggggacggcgcagaucauggaggugaccgccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucaccgaggacgaccugcagaacgaggcgaagaucacggacaucauggagcccgagcacgcccugcucgccaaguccaucuucaagcugaccuaccagaacaagguggugcgcguccagcggccggccaagaacgggaccgugauggacgugaucagccgccgcgaccagcggggcuccgggcaggucggcaccuacggccugaacacguucaccaacauggaggcccagcucauccgccagauggagagcgaggggaucuucucccccagcgagcuggagacccccaaccuggcgggccgggugcucgacuggcuggagaagcacgggguggagcgccugaagcggauggccaucuccggcgacgacugcgucgugaagcccaucgacgaccgcuucgccaccgcccucacggcccugaacgacauggggaaggugcggaaggacaucccgcagugggagcccagcaagggcuggaacgacuggcagcagguccccuucugcagccaccacuuccaccagcugaucaugaaggacggccgcgggaucguggugcccugccggaaccaggacgagcucgucggccgcgcgcgggugucccagggggccggcuggagccugcgcgagaccgccugccuggggaaguccuacgcccagauguggcagcucauguacuuccaccggcgcgaccugcggcuggcggccaacgccaucugcagcgccgugccggucgacugggugcccaccucccgcaccacguggagcauccacgcccaccaccaguggaugaccaccgaggacaugcucuccguguggaaccgggucuggaucgaggagaaccccuggauggaggacaagacccacaucagcuccuggggcgacgugcccuaccugggcaagcgcgaggaccaguggugcgggagccugaucggccucacggcgcgggccaccugggccaccaacauccagguggccaucaaccagguccgccgccugaucgggaacgagaacuaccuggacuacaugaccuccaugaagcgguucaagaacgagagcgacccggagggcgcccucugguga

SEQ ID NO: 8792 - RNA, 9879 nt, Artificial Sequence
  derived and/or modified CDS sequence (opt1) from DENV-1__EU482529__SS-prME
agcgugaccaugcugcugaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgcugcaggagaccuggaaccggcaggaccugcucgugaccuucaagaccgcccacgccaagaagcaggaggucguggugcugggcucccaggagggcgcgaugcacacggcccugaccggggccaccgagauccagaccagcggcacgaccaccaucuucgccgggcaccucaagugccgccugaagauggacaagcugacccucaagggcauguccuacgucaugugcacggggagcuucaagcuggagaaggagguggccgagacccagcacggcaccgugcugguccagaucaaguacgagggcaccgacgcgcccugcaagauccccuucuccacgcaggacgagaagggggugacccagaacggccggcugaucaccgccaacccgaucgugaccgacaaggagaagcccgucaacaucgaggccgagccgcccuucggggagagcuacaucaucaucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagaucuucggcaccgccuacggggugcuguucagcggcguguccuggacgaugaagaucgggaucggcguccugcucaccuggcugggccugaacagccgcuccaccagccucuccaugaccugcaucgccguggggcuggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgucgccggcauccuggcgcaggggaagaagaugauccggccccagcccauggaguacaaguacuccuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacucccacacccaggucugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucgucaagagcaugguguccgccggcagcggcgagguggacagcuucucccuggggcugcucugcaucagcaucaugaucgaggaggucaugcggucccgcuggagccggaagaugcugaugaccggcacgcuggccguguucuuccuccugaucauggggcagcugaccuggaacgaccucauccgccugugcaucauggugggcgccaacgcguccgaccgcauggggaugggcaccaccuaccuggcccucauggccacguucaagaugcggccgauguucgccgucggccugcuguuccgccggcucaccagccgcgaggugcugcugcucaccaucgggcugucccugguggccagcgucgagcuccccaacucccuggaggagcugggcgacgggcucgcgaugggcaucaugauccugaagcugcucaccgacuuccagagccaccagcugugggccacgcugcucucccugaccuucaucaagaccaccuucagccugcacuacgccuggaagacgauggccauggugcucuccaucgucagccuguucccccugugccucuccaccaccagccagaagaccacguggcugcccgugcugcucggcucccuggggugcaagccgcugaccauguuccucaucgcggagaacaagaucuggggccggcgcagcuggccccugaacgaggggaucauggccgugggcaucgucuccauccugcucagcagccugcugaagaacgacgugccccucgccgggccccugaucgccggcggcaugcugaucgccugcuacgugaucuccgggagcuccgcggaccucagccuggagaaggccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgcuguccauccccgccacccucuucgugugguacuucuggcagaagaagaagcagcgcagcgggguccugugggacacccccagcccgcccgagguggagcgggccgugcuggacgacggcaucuaccgcaucaugcagcggggccugcucgggcgcagccaggucggcguggggguguuccaggagaacgucuuccacaccauguggcacgugacgcggggcgccgugcugauguaccaggggaagcgccuggagcccuccugggcgagcgucaagaaggaccucaucuccuacggcggcggguggcggcugcagggcagcuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccuccggcagccccaucgucaaccgcgaggggaagaucgugggccucuacggcaacgggguggucaccaccuccggcacguacgugagcgcgaucgcccaggccaaggccagccaggaggggccgcugcccgagaucgaggacgagguguuccggaagcgcaaccugaccaucauggaccuccaccccggcuccgggaagacccggcgcuaccugccggcgaucguccgggaggccaucaagcgcaagcugcgcacccucauccuggcccccacgcgggugguggccagcgagauggccgaggcgcugaagggcaugcccauccgcuaccagaccaccgccgucaaguccgagcacaccggcaaggagaucguggaccucaugugccacgccacguucaccaugcggcugcugagccccgugcgcgucccgaacuacaacaugaucaucauggacgaggcccacuucaccgaccccuccagcaucgccgcgcggggguacaucuccacccgcgugggcaugggggaggccgccgccaucuucaugacggccacgccgcccggcagcguggaggcguucccgcaguccaacgccgucauccaggacgaggagcgggacauccccgagcgcagcuggaacuccggguacgaguggaucaccgacuuccccggcaagaccgugugguucgugcccagcaucaaguccggcaacgacaucgccaacugccuccggaagaacgggaagcgcgucauccagcugagccggaagacguucgacaccgaguaccagaagaccaagaacaacgacugggacuacguggugaccacggacaucuccgagaugggcgccaacuuccgcgcggaccgggucaucgacccgcgccggugccugaagcccgugauccucaaggacgggcccgagcgcgugauccuggccggccccaugccggucaccguggccagcgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucagcuacaagguggccuccgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacagcgacccccuggcccugcgggaguucaaggaguucgccgcgggccgccgguccgugagcggggaccucauccuggagaucggcaagcugccgcagcaccucacccagcgcgcccagaacgcccuggacaaccuggucaugcuccacaacuccgagcagggcgggcgggccuaccgccacgcgauggaggagcugcccgacacgaucgagacccugaugcuccuggcccugaucgccgugcucaccggcggggugacccuguucuuccugagcggccgggggcucggcaagaccuccaucggccugcugugcgucauggccagcuccgugcuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccagcgccuggacgcucuacgcgguggccaccaccaucaucaccccgaugaugcgccacacgaucgagaacaccaccgccaacaucucccugaccgccaucgccaaccaggcggccauccugauggggcucgacaagggcuggcccaucagcaagauggacaucggcgugccccugcuggcccucgggugcuacucccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccggcccccucaccacccugugggaggggagcccgggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggagguggaccgcuccgaggccaaggagggccucaagcgcggggagaccaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugacggaggugaagggguacaccaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgacgaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugacgagccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugagccgcaacaagaagccccggaucugcacccgcgaggaguucacgcggaagguccgcuccaacgcggccaucggcgccguguucguggacgagaaccaguggaacagcgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucacggaggacgaccuccagaacgaggcccgcaucaccgacaucauggagccggagcacgcccugcuggccaagagcaucuucaagcucaccuaccagaacaagguggugcgcguccagcggcccgccaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagacccccaaccuggccgagcgcgugcuggacuggcucgagaaguacggcguggagcggcugaagcgcauggccaucagcggggacgacugcgucgugaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggccggcuggagccuccgggagaccgcgugccugggcaagagcuacgcccagauguggcagcugauguacuuccaccgccgggaccuccgccuggccgccaacgcgaucugcuccgccgugcccgucgacuggauccccaccagccggacgaccugguccauccacgcccaccaccaguggaugaccaccgaggacaugcugagcguguggaaccgcguguggaucgaggagaaccccuggauggaggacaagacgcacaucuccagcuggggcgacgucccguaccucgggaagcgcgaggaccaguggugcggcucccugaucggccugaccgcccgggccaccugggcgaccaacauccagguggccaucaaccaggugcgccggcucaucgggaacgagaacuaccuggacuacaugaccagcaugaagcgcuucaagaacgagggcgaccccgagggggcccugugguga

SEQ ID NO: 8793 - RNA, 9879 nt, Artificial Sequence
  derived and/or modified CDS sequence (opt1) from DENV-1__EU482531__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccacguucaucaucgacgggcccaacaccccggagugccccaacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacccuguggagcaacggcgugcucgaguccgagauggugauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagcgggacgacacccugaccauccugcucaaggcgacccugcuggccgucuccggcguguacccgcucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcugcccgagaucgaggacgagguguuccggaagcgcaaccucaccaucauggaccugcaccccggcagcgggaagacgcggcgcuaccugccggcgaucguccgggaggccaucaagcgcaagcuccggacccugauccuggcccccacccgcgugguggccuccgagauggccgaggcgcucaagggcaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggacggaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugacgggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccaccccgccuccgccuggacccuguacgccguggcgacgaccaucaucaccccgaugaugcgccacaccaucgagaacacgaccgccaacaucagccugaccgccaucgccaaccaggccgcgauccucauggggcuggacaagggcuggcccaucuccaagauggacaucggcgugccccugcucgcccuggggugcuacagccaggucaacccccugacccucacggccgccgugcugaugcugguggcgcacuacgccaucaucggcccggggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccccugaccacccugugggagggguccccgggcaaguucuggaacaccacgaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacgcuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggccaagaucacggacaucauggagccggagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggcccagcucauccggcagauggagagcgaggggaucuuccugcccuccgagcuggagacccccaaccucgccgagcgcgugcuggacuggcuggagaagcacggcguggagcggcucaagcgcauggccaucagcggggacgacugcgucgugaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacgcacguguccagcuggggcgacgugccguaccuggggaagcgggaggaccaguggugcggcucccucaucggccugaccgcccgcgccaccugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8794 - RNA, 9879 nt, Artificial Sequence
  derived and/or modified CDS sequence (opt1) from DENV-1__EU482532__SS-prME
agcgugaccaugcugcucaugcugaugcccaccgcccuggccuuccaccucaccacccggggcggggagccgcacaugaucgugagcaagcaggagcggggcaagagccugcuguucaagaccagcgcgggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcggagcguggcccuggcgccccacgugggccucgggcuggagacgcgcaccgagaccuggaugagcuccgagggcgccuggaagcagauccagcgggucgagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccaccacccgccuggagaacaucauguggaagcagaucagcaacgagcugaaccacauccuccuggagaacgacaugaaguucaccgugguggucggggacguggccggcauccuggcgcaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacucccacacccaggugugcgaccaccgccugaugagcgcggccaucaaggacuccaaggccgugcacgccgacaugggcuacuggaucgagagcgagaagaacgagaccuggaagcucgcccgggcguccuucaucgaggucaagaccugcaucuggcccaagagccacacgcugugguccaacggcgugcuggagagcgagaugaucauccccaagaucuacgggggcccgaucucccagcacaacuaccgcagcggguacuucacccagaccgccggccccuggcaccucgggaagcuggagcuggacuucgaccucugcgagggcaccacgguggucguggacgagcacugcggcaaccgggggcccucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugaccggcacccucgccguguucuuccugcugaucauggggcagcucacguggaacgaccugauccggcugugcaucauggucggcgccaacgcgagcgaccgcauggggaugggcaccaccuaccucgcccugauggccaccuucaagaugcgccccauguucgccgugggccuccuguuccggcgccugacgucccgggaggugcugcuccugaccaucgggcugagccucgucgccuccguggagcugccgaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccaugguccugagcaucgugucccuguucccccucugccugagcacgaccucccagaagaccaccuggcugcccgugcuccugggcagccuggggugcaagccccucacgauguuccugaucgcggagaacaagaucuggggccgcaagagcuggccgcugaacgaggggaucauggccgucggcaucguguccauccuccugagcucccugcucaagaacgacgugccccuggccgggccccugaucgccggcggcaugcucaucgccugcuacgucaucagcggguccagcgcggaccugucccuggagaaggccgccgaggugagcugggaggaggaggccgagcacuccggcgccagccacaacauccucguggagguccaggacgacgggaccaugaagaucaaggacgaggagcgggacgacacccugaccauccugcucaaggcgacccugcuggccguguccggcguguacccccucagcaucccggccacgcuguucgucugguacuucuggcagaagaagaagcagcgcuccggggugcugugggacacccccuccccgcccgagguggagcgggccguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagccgagcugggcguccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagaccagcgagggcgaggucggcgccaucgcccucgacuucaagccggggacgagcggcucccccaucgugaaccgcgaggggaagaucgugggccuguacggcaacggggucgugaccaccagcggcaccuacguguccgcgaucgcccaggccaaggccagccaggaggggccccugcccgagaucgaggacgaggucuuccggaagcgcaaccucacgaucauggaccugcacccgggcuccgggaagacccggcgcuaccugcccgcgaucgugcgggaggccaucaagcgcaagcuccggacccugauccuggcccccacccgcguggucgccagcgagauggccgaggcgcucaagggcaugccgauccgcuaccagacgaccgccgugaaguccgagcacaccggcaaggagaucguggaccugaugugccacgccaccuucacgaugcggcugcucagccccguccgcgugcccaacuacaacaugaucaucauggacgaggcccacuucaccgaccccuccagcaucgccgcgcggggguacaucuccacccgcgugggcaugggggaggccgccgccaucuucaugaccgccacgccgcccggcagcgucgaggcguucccccaguccaacgccgugauccaggacgaggagcgggacauccccgagcgcagcuggaacuccggguacgaguggaucaccgacuucccgggcaagaccgugugguucguccccagcaucaaguccggcaacgacaucgccaacugccugcggaagaacgggaagcgcgugauccagcugagccggaagaccuucgacacggaguaccagaagaccaagaacaacgacugggacuacguggucaccaccgacaucuccgagaugggcgccaacuuccgcgcggaccgggugaucgacccccgccggugccucaagcccgugauccugaaggacgggccggagcgcgucauccuggccggccccaugcccgugacggucgccagcgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacaccccggagggcaucauccccgcccucuucgagcccgagcgggagaaguccgccgccaucgacggggaguaccgccugcgcggcgaggcgcggaagaccuucguggagcugaugcgccgcggggaccuccccguguggcuguccuacaaggucgccagcgagggcuuccaguacuccgaccgccgguggugcuucgacggcgagcgcaacaaccaggugcuggaggagaacauggacguggagaucuggacgaaggagggggagcggaagaagcuccgcccgcgguggcuggacgcccgcaccuacagcgacccccuggcccuccgggaguucaaggaguucgccgcgggccgccgguccgucagcggggaccugauccuggagaucggcaagcucccccagcaccugacccagcgcgcccagaacgcccuggacaaccucgugaugcugcacaacuccgagcagggcgggcgggccuaccgccacgcgauggaggagcugcccgacaccaucgagacgcucaugcugcuggcccucaucgccgugcugaccggcggggucacccuguucuuccucagcggccgggggcugggcaagaccuccaucggccugcucugcgugauggccagcuccgugcugcuguggauggccagcgucgagccgcacuggaucgcggccuccaucauccucgaguucuuccugauggugcugcucauccccgagcccgaccgccagcggacgccccaggacaaccagcuggccuacguggucaucgggcuccuguucaugauccugacgguggccgccaacgagaugggccugcucgagaccaccaagaaggaccuggggaucggccacguggcggccgagaaccaccaccacgccgccaugcuggacgucgaccuccacccggccagcgcguggacccuguacgccguggccacgaccaucaucacccccaugaugcgccacaccaucgagaacacgaccgccaacaucucccugaccgccaucgcgaaccaggccgccauccucauggggcuggacaagggcuggcccaucagcaagauggacaucggcgugccgcugcucgcccuggggugcuacucccaggucaacccccugacccucacggcggccgugcugaugcugguggcccacuacgccaucaucggccccgggcuccaggccaaggcgacccgggaggcccagaagcgcaccgccgccggcaucaugaagaaccccaccgucgacgggaucguggccaucgaccuggacccgguggucuacgacgcgaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacaccuacaagcggagcgggaucauggagguggaccgcuccgaggcgaaggagggccugaagcgcggggagacgaccaagcacgccgucagccgcggcaccgccaagcugcggugguucguggagcgcaaccucgugaagcccgaggggaaggucaucgaccugggcugcggccgcggcgggugguccuacuacugcgccgggcugaagaaggugaccgaggugaagggguacacgaagggcgggccgggccacgaggagcccauccccauggccaccuacggguggaaccuggucaagcuccacagcggcaaggacguguucuucaucccgcccgagaagugcgacacccugcugugcgacaucggggaguccagccccaaccccaccaucgaggagggccgcacgcuccgggugcugaagauggucgagcccuggcugcgcgggaaccaguucugcaucaagauccucaaccccuacaugcccuccgugguggagacccuggagcagaugcagcggaagcacggcggcaugcugguccgcaacccccucagccggaacuccacccacgagauguacugggugagcugcgggaccggcaacaucguguccgcggucaacaugaccagccgcaugcugcugaaccgguucacgauggcccaccgcaagcccaccuacgagcgcgacguggaccucggggccggcacccggcacguggccgucgagccggagguggccaaccuggacaucaucggccagcgcaucgagaacaucaagcacgagcacaaguccaccuggcacuacgacgaggacaaccccuacaagacgugggcguaccacgggagcuacgaggugaagcccagcggcuccgccagcuccauggucaacgggguggucaagcugcucaccaagcccugggacgugaucccgauggugacccagaucgccaugaccgacacgacccccuucggccagcagcgggucuucaaggagaagguggacacccgcacccccaaggccaagcgggggacggcccagaucauggaggugaccgcgaaguggcuguggggcuuccugagccgcaacaagaagccccggaucugcacccgcgaggaguucacccggaagguccgcuccaacgccgccaucggcgccguguucguggacgagaaccaguggaacagcgcgaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcggggucgagggcgaggggcugcacaagcugggcuacauccuccgcgacaucuccaagauccccgggggcaacauguacgccgacgacaccgccggcugggacacccggaucaccgaggacgaccugcagaacgaggccaagaucacggacaucauggagcccgagcacgcgcugcucgccaagagcaucuucaagcugaccuaccagaacaagguggugcgcguccagcggcccgccaagaacgggaccgugauggacgugaucucccgccgcgaccagcggggcagcgggcaggucggcaccuacggccugaacacguucaccaacauggaggcccagcucauccgccagauggaguccgaggggaucuucagcccguccgagcuggagacccccaaccuggccggccgggugcucgacuggcuggagaagcacgggguggagcgccugaagcggauggcgaucagcggcgacgacugcgucgugaagcccaucgacgaccgcuucgccaccgcccucacggcccugaacgacauggggaaggugcggaaggacaucccccagugggagccgagcaagggcuggaacgacuggcagcagguccccuucugcucccaccacuuccaccagcugaucaugaaggacggccgcgagaucguggugcccugccggaaccaggacgagcucgucgggcgcgcccgggugagccagggcgcgggguggucccugcgcgagaccgccugccugggcaagagcuacgcccagauguggcagcucauguacuuccaccggcgcgaccugcggcuggccgcgaacgccaucugcuccgccgugcccgucgacugggugccgaccagccgcaccacgugguccauccacgcccaccaccaguggaugaccaccgaggacaugcucagcguguggaaccgggucuggaucgaggagaaccccuggauggaggacaagacccacaucuccagcuggggcgacgugcccuaccugggcaagcgcgaggaccaguggugcggcucccugaucgggcucacggcccgggcgaccugggccaccaacauccagguggccaucaaccagguccgccgccugaucggcaacgagaacuaccuggacuacaugaccagcaugaagcgguucaagaacgaguccgaccccgagggggcccucugguga

SEQ ID NO: 8795 - RNA, 9879 nt, Artificial Sequence
  derived and/or modified CDS sequence (opt1) from DENV-1__EU482533__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaccguccaguacgagaaccugaaguacagcgugaucgugaccguccacacgggcgaccagcaccagguggggaacgaguccaccgagcacggcaccaccgcgaccaucacgccccaggcccccagcaccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccuccaccagccaggagacguggaaccggaaggaccuccuggugaccuucaagaccgcccacgcgaagaagcaggaggucaucgugcugggcucccaggagggcgccaugcacaccgcccucacgggggccaccgagauccagaccagcggcaccacgaccaucuucgccgggcaccugaagugccgccugaagauggacaagcucacccugaagggcauguccuacgugaugugcaccgggagcuucaagcuggagaaggaggucgcggagacgcagcacggcaccgugcucgugcagaucaaguacgagggcaccgacgcccccugcaagauccccuucuccacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccguggggaagcugguccaccagaucuucggcaccgccuacggggugcuguucagcggcguguccuggaccaugaagaucgggaucggcguccuccugacguggcugggccucaacagccgcuccaccagccuguccaugaccugcaucgccguggggcuggugacccucuaccugggcgucauggugcaggccgacagcgggugcgugaucaacuggaagggccgggagcugaagugcgggagcggcaucuucgucacgaacgaggugcacaccuggaccgagcaguacaaguuccaggcggacuccccgaagcgccucagcgccgccaucggcaaggccugggaggagggggugugcggcauccgguccgccacccgccuggagaacaucauguggaagcagaucagcaacgagcugaaccacauccuccuggagaacgacaugaaguucaccgucguggugggggacgucgcgggcauccuggcccaggggaagaagaugauccggccccagcccauggaguacaaguacuccuggaaguccuggggcaaggccaagaucaucggcgccgacgugcagaacgcgacguucaucaucgacgggcccaacaccccggagugccccgacgaccagcgcgccuggaacaucugggagguggaggacuacggcuucgggaucuucaccaccaacaucuggcucaagcugcgggacuccuacacgcaggucugcgaccaccgccugaugagcgccgccaucaaggacuccaaggccgugcacgcggacaugggcuacuggaucgagagcgagaagaacgagaccuggaagcucgcccgggccuccuucaucgaggugaagaccugcaucuggcccaagagccacacccugugguccaacggcguccuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgugguggucgacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgugaaggagaaggaggagaaccuggucaagagcauggugagcgccggcuccggcgagguggacagcuucucccuggggcuccugugcaucagcaucaugaucgaggaggucaugcgcucccgguggagccgcaagaugcugaugaccggcacccucgcgguguucuuccugcugaucauggggcagcucaccuggaacgaccugauccggcugugcaucauggugggcgccaacgccuccgaccgcauggggaugggcacgaccuaccucgcccugauggccaccuucaagaugcgcccgauguucgcggucggccuccuguuccggcgccugaccagccgggaggugcugcuccugacgaucgggcugucccucguggccagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgcguggaagaccauggccauggugcuguccaucgucagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgugggcaucgucagcauccuccuguccagccugcucaagaacgacgugccccuggccgggccccugaucgcgggcggcaugcucaucgccugcuacgugaucuccgggagcuccgccgaccugagccuggagaaggccgccgaggucuccugggaggaggaggcggagcacagcggcgccucccacaacauccucguggaggugcaggacgacgggacgaugaagaucaaggacgaggagcgggacgacacccugaccauccugcucaaggccacccugcuggccgucagcggcguguacccgcucuccauccccgccacccuguucgugugguacuucuggcagaagaagaagcagcgcagcgggguccugugggacacgcccagcccgcccgagguggagcgggcggugcucgacgacggcaucuaccgcaucaugcagcggggccugcuggggcgcagccaggucggcguggggguguuccaggagaacgucuuccacaccauguggcacgugacccggggcgccgugcugauguaccaggggaagcgccucgagcccuccugggccagcgucaagaaggaccugaucuccuacggcggcggguggcggcugcagggcagcuggaacaccggggaggagguccaggugaucgccgucgagcccggcaagaaccccaagaacgugcagacggcccccgggaccuucaagaccuccgagggcgaggugggcgcgaucgcccucgacuucaagcccgggaccagcggcagccccaucgucaaccgcgaggggaagaucgugggccuguacggcaacgggguggucacgaccuccggcaccuacgugagcgccaucgcccaggcgaaggccucccaggaggggccccugccggagaucgaggacgagguguuccggaagcgcaaccucaccaucauggaccugcaccccggcagcgggaagacgcggcgcuaccugcccgccaucguccgggaggccaucaagcgcaagcuccggacccugauccuggccccgacccgcgugguggcguccgagauggccgaggcccucaagggcaugcccauccgcuaccagaccacggccgucaagagcgagcacaccggcaaggagaucguggaccugaugugccacgccaccuucaccaugcggcugcucucccccgugcgcguccccaacuacaacaugaucaucauggacgaggcgcacuucacggacccgagcuccaucgccgcccggggguacaucagcacccgcgugggcaugggggaggccgccgcgaucuucaugaccgccacgccgcccggcuccguggaggccuucccccagagcaacgccgucauccaggacgaggagcgggacaucccggagcgcuccuggaacagcggguacgaguggaucacggacuuccccggcaagaccgugugguucgugcccuccaucaagagcggcaacgacaucgcgaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgccgaccgggucaucgacccccgccggugccucaagccggugauccugaaggacgggcccgagcgcgugauccuggccggccccaugcccgucaccguggccuccgcggcccagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgcggccaucgacggggaguaccgccugcgcggcgaggcccggaagaccuucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcgcuccgggaguucaaggaguucgccgccggccgccggagcguguccggggaccugauccuggagaucggcaagcucccccagcaccugacccagcgcgcccagaacgcgcuggacaaccucgucaugcugcacaacagcgagcagggcgggcgggccuaccgccacgccauggaggagcugccggacaccaucgagacccucaugcugcuggcccucaucgccgugcugacgggcggggugacccuguucuuccucuccggccgggggcugggcaagaccagcaucggccugcucugcgucauggcguccagcgugcugcuguggauggccuccguggagccccacuggaucgccgccagcaucauccucgaguucuuccugaugguccugcucauccccgagcccgaccgccagcggaccccgcaggacaaccagcuggccuacguggugaucgggcuccucuucaugauccugaccgucgcggccaacgagaugggccugcucgagacgaccaagaaggaccuggggaucggccacguggccguggagaaccaccaccacgccgccaugcuggacgucgaccuccaccccgcguccgccuggacccuguacgccguggccaccacgaucaucacccccaugaugcgccacaccaucgagaacaccacggccaacaucagccugaccgcgaucgccaaccaggccgccauccucauggggcuggacaagggcuggccgaucuccaagauggacaucggcgugccccugcucgcgcuggggugcuacagccaggucaacccccugacccucaccgccgccgugcugaugcugguggcccacuacgccaucaucggccccgggcuccaggcgaaggccacgcgggaggcccagaagcgcaccgccgccggcaucaugaagaacccgaccgucgacgggaucguggcgaucgaccuggaccccguggucuacgacgccaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggcgaacaucuuccgggggagcuaccucgccggcgccggccuggccuucucccugaugaagucccucgggggcgggcgccggggcacgggggcgcagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacaccaagggcgggcccggccacgaggagcccauccccauggcgacguacggguggaaccuggucaagcuccacuccggcaaggacguguucuucaucccgcccgagaagugcgacacccugcugugcgacaucggggagagcucccccaaccccaccaucgaggagggccgcacccuccgggugcugaagauggucgagccguggcugcgcgggaaccaguucugcaucaagauccucaaccccuacaugcccagcgugguggagacgcuggagcagaugcagcggaagcacggcggcaugcugguccgcaacccccucucccggaacagcacccacgagauguacuggguguccugcgggaccggcaacaucgugagcgccgucaacaugaccucccgcaugcugcugaaccgguucaccauggcccaccgcaagccgacguacgagcgcgacguggaccucggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagcccagcggcagcgccuccagcauggucaacgggguggucaagcugcucacgaagccgugggacgugauccccauggugacccagaucgccaugaccgacaccacgcccuucggccagcagcgggucuucaaggagaagguggacacccgcacccccaaggccaagcgggggaccgcgcagaucauggaggugacggccaaguggcuguggggcuuccugucccgcaacaagaagccgcggaucugcacccgcgaggaguucacccggaagguccgcagcaacgccgccaucggcgcgguguucguggacgagaaccaguggaacuccgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggcgaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgccgacgacacggccggcugggacacccggaucaccgaggacgaccugcagaacgaggcgaagaucaccgacaucauggagcccgagcacgcccugcucgccaaguccaucuucaagcugacguaccagaacaagguggugcgcguccagcggccggccaagaacgggaccgugauggacgugaucagccgccgcgaccagcggggcuccgggcaggucggcaccuacggccugaacaccuucacgaacauggaggcccagcucauccgccagauggagagcgaggggaucuucucccccagcgagcuggagacccccaaccuggcgggccgggugcucgacuggcuggagaagcacgggguggagcgccugaagcggauggccaucuccggcgacgacugcgucgugaagcccaucgacgaccgcuucgccaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagacggccugccugggcaaguccuacgcccagauguggcagcucauguacuuccaccggcgcgaccugcggcuggcggccaacgccaucugcagcgccgugccggucgacugggugcccaccucccgcaccaccuggagcauccacgcccaccaccaguggaugacgaccgaggacaugcucuccguguggaaccgggucuggaucgaggagaaccccuggauggaggacaagacccacaucagcuccuggggcgacgugcccuaccugggcaagcgcgaggaccaguggugcggcagccugaucgggcucaccgcgcgggccacgugggccaccaacauccagguggccaucaaccagguccgccgccugaucggcaacgagaacuaccuggacuacaugaccuccaugaagcgguucaagaacgagagcgacccggagggggcccucugguga

SEQ ID NO: 8796 - RNA, 9879 nt, Artificial Sequence
  derived and/or modified CDS sequence (opt1) from DENV-1__EU482534__SS-prME
agcgugaccaugcugcugaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucguccgcacgaccuucagccugcacuacgccuggaagaccauggcgauggugcuguccaucgugagccucuucccccugugccuguccaccacgagccagaagaccaccuggcuccccguccugcugggcucccucgggugcaagccgcugaccauguuccugaucgccgagaacaagaucuggggccgcaagagcuggccccucaacgaggggaucauggccgugggcaucgugagcauccugcuguccagccuccugaagaacgacgucccccuggccgggccccucaucgccggcggcaugcugaucgcgugcuacgugaucuccgggagcuccgccgaccugagccucgagaaggccgccguggucuccugggaggaggaggccgagcacagcggcgcgucccacaacauccugguggaggugcaggacgacgggacgaugaagaucaaggacgaggagcgcgacgacacccugaccauccuccugaaggccacccugcucgccgucagcggcguguacccgcuguccauccccgccacccuguucgugugguacuucuggcagaagaagaagcagcggagcgggguccucugggacacgcccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgcggugcucauguaccaggggaagcggcuggagcccuccugggccagcgucaagaaggaccugaucuccuacggcggcggguggcgccuccagggcagcuggaacaccggggaggagguccaggugaucgccgucgagcccggcaagaaccccaagaacgugcagacggcccccgggaccuucaagaccuccgagggcgaggugggcgccaucgcgcuggacuucaagcccgggaccagcggcagccccaucgucaaccgggaggggaagaucgugggccuguacggcaacgggguggucacgaccuccggcaccuacgugagcgccaucgcccaggccaaggcgucccaggaggggccccucccggagaucgaggacgagguguuccgcaagcggaaccugaccaucauggaccugcaccccggcagcgggaagacgcgccgguaccuccccgccaucguccgcgaggccaucaagcggaagcugcgcacccugauccucgccccgacccgcgugguggccuccgagauggcggaggcccugaagggcaugcccauccgguaccagaccacggccgucaagagcgagcacaccggcaaggagaucguggaccugaugugccacgccaccuucaccaugcgccuccugucccccgugcggguccccaacuacaacaugaucaucauggacgaggcccacuucacggacccgagcuccaucgcggcccgcggguacaucagcacccgggugggcaugggggaggccgccgccaucuucaugaccgcgacgccgcccggcuccguggaggccuucccccagagcaacgccgucauccaggacgaggagcgcgacaucccggagcgguccuggaacagcggguacgaguggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgcgaacuuccgggccgaccgcgucaucgacccccggcgcugccugaagccggugauccugaaggacgggcccgagcgggucauccucgccggccccaugcccgugaccguggccuccgccgcgcagcgccgggggcgcaucggccggaaccacaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgcgagaaguccgccgcgaucgacggggaguaccgccugcggggcgaggcccgcaagaccuucgucgagcucaugcggcgcggggaccugccgguguggcugagcuacaagguggccuccgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcccugcgcgaguucaaggaguucgcggccggccggcgcagcguguccggggaccugauccucgagaucggcaagcugccccagcaccugacccagcgggcccagaacgcccucgacaaccuggucaugcugcacaacagcgagcagggcgggcgcgcguaccggcacgccauggaggagcucccggacaccaucgagacccugaugcugcucgcccugaucgccgugcugacgggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagcccgaccggcagcgcaccccgcaggacaaccagcuggccuacguggugaucgggcuccuguucaugauccugaccgucgccgcgaacgagaugggccuccuggagacgaccaagaaggaccuggggaucggccacguggccguggagaaccaccaccacgccgccaugcucgacgucgaccugcaccccgccuccgcguggacccuguacgccguggccaccacgaucaucacccccaugaugcggcacaccaucgagaacaccacggccaacaucagccucaccgccaucgcgaaccaggccgccauccugauggggcuggacaagggcuggccgaucuccaagauggacaucggcgugccccuccuggcccuggggugcuacagccaggucaacccccucacccugaccgcggccgugcugaugcucguggcccacuacgccaucaucggccccgggcugcaggccaaggcgacgcgcgaggcccagaagcgcaccgccgccggcaucaugaagaacccgaccgucgacgggaucguggccaucgaccuggaccccguggucuacgacgcgaaguucgagaagcagcucggccagaucaugcugcugauccucugcaccucccagauccugcugaugcggacgaccugggcccucugcgagagcaucacccuggccaccggcccccugacgacccucugggaggggucccccggcaaguucuggaacaccaccaucgccgugagcauggccaacaucuuccgcgggagcuaccuggcgggcgccggccuggccuucucccucaugaagucccucgggggcgggcggcgcgggacgggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagaccacgaagcacgccgucucccggggcaccgccaagcuccgcugguucguggagcggaaccuggugaagccggaggggaaggucaucgaccugggcugcggccgcgggggcuggagcuacuacugcgccgggcugaagaaggugaccgaggugaagggcuacaccaagggcgggcccggccacgaggagcccauccccauggccacguacggguggaaccucgucaagcugcacuccggcaaggacguguucuucaucccgcccgagaagugcgacacccugcucugcgacaucggggagagcucccccaaccccaccaucgaggagggccggacccugcgcgugcugaagauggucgagccguggcuccgggggaaccaguucugcaucaagauccugaaccccuacaugcccagcgugguggagacgcuggagcagaugcagcgcaagcacggcggcaugcucguccggaacccccugucccgcaacagcacccacgagauguacuggguguccugcgggaccggcaacaucgugagcgcggucaacaugaccucccggaugcugcucaaccgcuucaccauggcccaccgcaagccgacguacgagcgggacguggaccugggggccggcacccgccacguggccgucgagcccgagguggccaaccuggacaucaucggccagcggaucgagaacaucaagcacgagcacaagagcaccuggcacuacgacgaggacaaccccuacaagaccugggcguaccacggguccuacgaggucaagcccagcggcagcgccuccagcauggugaacgggguggucaagcuccugacgaagccgugggacgugauccccauggugacccagaucgccaugaccgacaccacgcccuucggccagcagcgcgucuucaaggagaagguggacacccggacccccaaggccaagcgcgggaccgcccagaucauggaggugacggcgaaguggcuguggggcuuccucucccggaacaagaagccgcgcaucugcacccgggaggaguucacccgcaagguccggagcaacgccgccaucggcgccguguucguggacgagaaccaguggaacuccgcgaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccggggucgagggcgaggggcugcacaagcucggcuacauccugcgggacaucagcaagauccccgggggcaacauguacgccgacgacacggccggcugggacacccgcaucaccgaggacgaccugcagaacgaggccaagaucaccgacaucauggagcccgagcacgcgcuccuggccaaguccaucuucaagcugacguaccagaacaagguggugcggguccagcgcccggccaagaacgggaccgugauggacgugaucagccgccgggaccagcgcggcuccgggcaggucggcaccuacggccucaacaccuucacgaacauggaggcccagcugauccggcagauggagagcgaggggaucuucucccccagcgagcuggagacccccaaccucgccggccgcgugcuggacuggcuggagaagcacgggguggagcggcucaagcgcauggcgaucuccggcgacgacugcgucgugaagcccaucgacgaccgguucgccaccgcccugaccgcccugaacgacauggggaaggugcgcaaggacaucccgcagugggagcccagcaagggcuggaacgacuggcagcagguccccuucugcagccaccacuuccaccagcucaucaugaaggacggccgggagaucguggugcccugccgcaaccaggacgagcuggucgggcgggcccgcgugucccagggcgcgggguggagccugcgggagacggccugccucggcaaguccuacgcccagauguggcagcugauguacuuccaccgccgggaccugcgccucgccgcgaacgccaucugcagcgccgugccggucgacugggugcccaccucccggaccaccuggagcauccacgcccaccaccaguggaugacgaccgaggacaugcuguccguguggaaccgcgucuggaucgaggagaaccccuggauggaggacaagacccacaucagcuccuggggcgacgugcccuaccugggcaagcgggaggaccaguggugcggcagccucaucgggcugaccgcccgcgcgacgugggccaccaacauccagguggccaucaaccagguccgccggcugcucggcaacgagaacuaccuggacuacaugaccuccaugaagcgcuucaagaacgagagcgacccggagggggcccugugguga

SEQ ID NO: 8797 - RNA, 9879 nt, Artificial Sequence
  derived and/or modified CDS sequence (opt1) from DENV-1__EU482535__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcaucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccguggucgugggggacguggucggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagaugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccggcucugcaucauggugggcgccaacgcgagcgaccgcauggggaugggcaccaccuaccuggcccugauggccaccuucaagaugcgcccgauguucgccgucgggcuccuguuccggcgccugacgucccgggaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacccugcugagccucacguucaucaagaccacccugucccugcacuacgccuggaagaccauggccauggugcucagcaucgucucccugaucccccugugccucagcacgaccucccagaagaccaccuggcugcccgugcugcucggcagccuggggugcaagccgcugacgauguuccucaucgcggagaacaagaucuggggccgcaaguccuggccccugaacgaggggaucauggccgugggcgucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagccccgcaagaaccccaagaacgugcagaccgcccccggcaccuucaagacccccgagggggaggucggcgccaucgcccuggacuucaagcccggcacgagcgggucccccaucgugaaccgggagggcaagaucguggggcucuacggcaacggcgucgugaccaccagcgggaccuacgugagcgcgaucgcccaggccaaggccucccaggagggcccgcugcccgagaucgaggacgaggucuuccgcaagcggaaccugacgaucauggaccuccaccccgggagcggcaagacccgccgguaccugccggcgaucgugcgcgaggccaucaagcggaagcugcgcacccucauccuggcccccacccgcguggucgccuccgagauggccgaggcgcugaaggggaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgccgcgcgcggcuacaucagcacccggguggggaugggcgaggccgccgccaucuucaugaccgccacgccgcccggguccgucgaggcguucccgcagagcaacgccgugauccaggacgaggagcgcgacauccccgagcgguccuggaacagcggcuacgaguggaucaccgacuuccccgggaagaccgugugguucguccccuccaucaagagcggcaacgacaucgccaacugccuccgcaagaacggcaagcgggugauccagcugucccgcaagaccuucgacacggaguaccagaagaccaagaacaacgacugggacuacguggucaccaccgacaucagcgagaugggggccaacuuccgggcggaccgcgugaucgacccgcggcgcugccugaagcccgugauccucaaggacggccccgagcgggucauccuggccgggcccaugccggugacggucgccuccgccgcccagcgccggggccgcaucgggcggaaccacaacaaggagggcgaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccaucgacggcgaguaccgccuccgcggggaggcgcgcaagaccuucguggagcugaugcggcgcggcgaccugcccguguggcucuccuacaaggucgccagcgagggguuccaguacagcgaccggcgcuggugcuucgacggcgagcggaacaaccaggugcuggaggagaacaucgacguggagaucuggacgaaggagggcgagcgcaagaagcugcggccccgcuggcucgacgcccggaccuacuccgacccccuggcccugcgcgaguucaaggaguucgccgcggggcggcgcagcgucuccggcgaccucauccuggagaucgggaagcugccgcagcaccucacccagcgggcccagaacgcccuggacaaccuggugaugcuccacaacagcgagcagggcggccgcgccuaccggcacgcgauggaggagcugcccgacaccaucgagacgcugaugcuccuggcccugaucgccgugcucaccgggggcgucacccuguucuuccuguccgggcgcggccucgggaagaccagcaucggccugcugugcgugauggccuccagcgugcuccuguggauggccuccgucgagccccacuggaucgcggccagcaucauccuggaguucuuccucauggugcugcugauccccgagccggaccggcagcgcacgccccaggacaaccagcucgccuacguggucaucggccugcuguucaugauccucacgguggccgccaacgagauggggcugcuggagaccaccaagaaggaccucggcaucgggcacgcggccguggagaaccaccaccacgccaccaugcuggacgucgaccugcaccccgccuccgccuggacgcucuacgcgguggccaccaccaucaucaccccgaugaugcggcacacgaucgagaacaccaccgccaacaucagccugaccgccaucgccaaccaggcggccauccugaugggccucgacaagggguggcccaucuccaagauggacaucggcgugccccugcuggcccucggcugcuacagccaggucaacccccugacgcugaccgccgcggugcucaugcugguggcccacuacgccaucaucgggccgggccugcaggccaaggccacccgcgaggcgcagaagcgcaccgccgccgggaucaugaagaaccccacggucgacggcaucguggccaucgaccucgaccccguggucuacgacgccaaguucgagaagcagcuggggcagaucaugcugcucauccugugcaccucccagauccugcucaugcggaccaccugggcgcugugcgagagcaucacgcuggccaccggcccccucaccacccugugggagggcuccccggggaaguucuggaacacgaccaucgccgugagcauggccaacaucuuccgcggcuccuaccuggccggggcgggccucgccuucagccugaugaagucccugggcgggggccggcgcgggaccggcgcccagggggagacccucggcgagaaguggaagcggcagcugaaccagcuguccaagagcgaguucaacaucuacaagcgcuccggcaucauggagguggaccggagcgaggccaaggaggggcucaagcgcggcgagacgacccggcacgcggucucccgcgggaccgccaagcugcggugguucguggagcgcaaccuggugaagcccgagggcaaggucaucgaccuggggugcggccggggcggguggagcuacuacugcgccggccucaagaaggugaccgaggugaagggguacacgaagggcgggcccggccacgaggagcccaucccgauggccaccuacggcuggaaccuggucaagcugcacuccgggaaggacguguucuucacgccgcccgagaagugcgacacccuccugugcgacaucggcgagagcucccccaacccgacgaucgaggaggggcgcacccugcgggugcucaagauggucgagcccuggcugcgcggcaaccaguucugcaucaagauccugaaccccuacaugcccagcgugguggagacccucgagcagaugcagcggaagcacgggggcaugcugguccgcaacccgcugucccggaacagcacccacgagauguacuggguguccugcggcaccgggaacaucgugagcgccgucaacaugacgucccgcaugcuccugaaccgcuucaccauggcgcaccggaagcccaccuacgagaaggacguggaccugggcgccgggacccgccacguggccgucgagcccgagguggccaaccucgacaucaucggccagcggaucgagaacaucaagcacgagcacaagagcacguggcacuacgacgaggacaaccccuacaagaccugggccuaccacggcuccuacgaggugaagccgagcggguccgcgagcagcauggucaacggcguggucaagcugcugaccaagcccugggacgugauccccauggugacccagaucgccaugacggacaccacccccuucgggcagcagcgcgucuucaaggagaagguggacacccggacgccgaaggccaagcgcggcaccgugcagaucauggaggucaccgcccgguggcucuggggguuccugucccgcaacaagaagccccggaucugcacccgcgaggaguucacgcggaaggugcgcagcaacgccgcgaucggcgccguguucgucgacgagaaccaguggaacuccgccaaggaggccguggaggacgagcgguucugggaccuggugaagaaggagcgcgagcuccacaagcagggcaagugcgcgaccugcgucuacaacaugauggggaagcgggagaagaagcugggcgaguucgggaaggccaagggcagccgcgccaucugguacauguggcugggggcccgguuccucgaguucgaggcccugggcuucaugaacgaggaccacugguucucccgcgagaacagccuguccggcguggagggggagggccuccacaagcugggguacauccugcgggacaucagcaagauccccggcgggaacauguacgcggacgacaccgccggcugggacacccgcaucacggaggacgaccuccagaacgaggccaagaucaccgacaucauggagccggagcacgcccugcuggccaccuccaucuucaagcucaccuaccagaacaaggugguccgggugcagcgccccgcgaagaacggcacggugauggacgucaucagccgccgggaccagcgcggguccggccagguggggaccuacggccugaacaccuucaccaacauggaggcccagcugauccggcagauggagagcgagggcaucuuccuccccuccgagcuggagacgcccaaccuggccgagcgcgugcucgacuggcuggagaaguacggggucgagcggcugaagcgcauggccaucagcggcgacgacugcguggugaagccgaucgacgaccgguucgccaccgcgcucaccgcccugaacgacauggggaagguccgcaaggacaucccccagugggagcccuccaagggcuggaacgacuggcagcagguccccuucugcagccaccacuuccaccagcugaucaugaaggacgggcgggagaucguggucccgugccgcaaccaggacgagcucgugggccgggcccgcgugucccagggcgccggguggagccugcgggagaccgccugccugggcaagagcuacgcgcagauguggcagcucauguacuuccaccgccgggaccugcgccuggccgccaacgccaucugcuccgcgguccccgugaacugggugcccacgagccggaccaccugguccauccacgcccaccaccaguggaugaccacggaggacaugcucagcgucuggaaccgcguguggaucgaggagaaccccuggauggaggacaagacccacguguccagcuggggcgacgucccguaccugggcaagcgggaggaccaguggugcgggucccugaucggccucaccgcccgcgccaccugggccagcaacauccagguggcgaucaaccaggugcgccggcugaucggcaacgagaacuaccuggacuacaugaccuccaugaagcgcuucaagaacgagggggaccccgagggcgcccucugguga

SEQ ID NO: 8798 - RNA, 9879 nt, Artificial Sequence
  derived and/or modified CDS sequence (opt1) from DENV-1__EU482536__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaagcugaccgugguggucggggacguggcgggcauccucgcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcugcgggacuccuacacccaggugugcgaccaccgccucaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgcgaacgccuccgaccgcauggggaugggcacgaccuaccuggcccugauggccaccuucaagaugcgcccgauguucgccgugggccuccuguuccggcgccugaccagccgggaggugcuccugcugacgaucgggcucucccuggucgcgagcguggagcugcccaacucccucgaggagcugggcgacgggcuggccaugggcaucaugauccucaagcugcugaccgacuuccagagccaccagcucugggccacccugcugucccucaccuucauccgcacgaccuucagccugcacuacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacaugcugaccauccuccugaaggccacccugcucgccgugagcggcguguacccgcuguccauccccgccacccuguucgucugguacuucuggcagaagaagaagcagcggagcggggugcucugggacacccccagcccgcccgagguggagcgcgccguccuggacgacggcaucuaccggaucaugcagcgcggccugcuggggcggagccaggugggcgugggggucuuccaggagaacguguuccacacgauguggcacgugacccgcggcgcgguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagaccgcccccgggacguucaagaccuccgagggcgaggucggcgccaucgcgcuggacuucaagcccgggaccagcggcagccccaucgugaaccgggaggggaagaucgugggccuguacggcaacggggucgugaccacguccggcaccuacgugagcgccaucgcccaggccaaggcgucccaggaggggccccucccggagaucgaggacgaggucuuccgcaagcggaaccugaccaucauggaccugcaccccggcagcgggaagacccgccgguaccuccccgccaucgugcgcgaggccaucaagcggcgccugcgcacgcugauccucgccccgacccggguggucgccuccgagauggcggaggcccugaagggcaugcccauccgcuaccagaccaccgccgucaagagcgagcacacgggcaaggagaucguggaccugaugugccacgccaccuucaccaugcggcuccugucccccguccgcgugcccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgcgaacuuccgcgccgaccgggugaucgacccccgccggugccugaagccggugauccugaaggacgggcccgagcgcgucauccucgccggccccaugcccgugaccgucgccuccgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgagcccgagcgcgagaaguccgccgcgaucgacggggaguaccggcugcgcggcgaggcccggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccccagcaccugacgcagcgcgcccagaacgcccucgacaaccuggugaugcugcacaacagcgagcagggcgggcgggcguaccgccacgccauggaggagcucccggacaccaucgagacccugaugcugcucgcccugaucgccgugcugaccggcggggucacgcuguucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagaccacgaagaaggaccuggggaucggccacguggccgucgagaaccaccaccacgccgccaugcucgacguggaccugcaccccgccuccgcguggacccuguacgccguggccaccaccaucaucacgcccaugaugcgccacaccaucgagaacaccaccgccaacaucagccucacggccaucgcgaaccaggccgccauccugauggggcuggacaagggcuggccgaucuccaagauggacaucggcgucccccuccuggcccuggggugcuacagccaggugaacccccucacccugaccgcggccgugcugaugcucgucgcccacuacgccaucaucggccccgggcugcaggccaaggcgacccgcgaggcccagaagcggacggccgccggcaucaugaagaacccgaccguggacgggaucguggccaucgaccuggaccccgucguguacgacgcgaaguucgagaagcagcucggccagaucaugcugcugauccucugcaccucccagauccugcugaugcgcaccacgugggcccucugcgagagcaucacccuggccaccggcccccugaccacgcucugggaggggucccccggcaaguucuggaacaccaccaucgccgugagcauggccaacaucuuccgggggagcuaccuggcgggcgccggccuggccuucucccucaugaagucccucgggggcgggcgccgggggaccggggcccagggcgagacgcugggcgagaaguggaagcgccagcucaaccagcuguccaagagcgaguucaacaccuacaagcgguccgggaucauggaggucgaccgcagcgaggcgaaggagggccugaagcgcggggagaccaccaagcacgccgugucccgcggcacggccaagcuccggugguucguggagcgcaaccuggucaagccggaggggaaggugaucgaccugggcugcggccgcggcggguggagcuacuacugcgccgggcugaagaaggugaccgaggucaagggguacaccaagggcgggcccggccacgaggagcccauccccauggccaccuacggguggaaccucgugaagcugcacuccggcaaggacguguucuucaucccgcccgagaagugcgacacgcugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacgcacgagauguacuggguguccugcgggaccggcaacaucgucagcgcggugaacaugaccucccgcaugcugcucaaccgcuucaccauggcccaccggaagccgaccuacgagcgcgacguggaccugggggccggcacgcggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcuccugaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgcgaaguggcuguggggcuuccucucccgcaacaagaagccgcggaucugcacgcgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacgcggaucaccgaggacgaccugcagaacgaggccaagaucaccgacaucauggagcccgagcacgcgcuccuggccaaguccaucuucaagcugaccuaccagaacaaggugguccgcgugcagcgcccggccaagaacgggacggugauggacgucaucagccggcgcgaccagcggggcuccggccaggugggcaccuacggccucaacaccuucaccaacauggaggcccagcugauccgccagauggagagcgaggggaucuucucccccagcgagcuggagacgcccaaccucgccggccgggugcuggacuggcuggagaagcacggggucgagcgccucaagcggauggcgaucuccggcgacgacugcguggugaagcccaucgacgaccgcuucgccaccgcccugaccgcccugaacgacauggggaagguccggaaggacaucccgcagugggagcccagcaagggcuggaacgacuggcagcagguccccuucugcagccaccacuuccaccagcucaucaugaaggacggccgcgagaucgugguccccugccggaaccaggacgagcugguggggcgcgcccgggugucccagggcgcgggguggagccugcgcgagaccgccugccucggcaaguccuacgcccagauguggcagcugauguacuuccaccggcgcgaccugcggcucgccgcgaacgccaucugcagcgccgucccgguggacugggugcccacgucccgcaccaccuggagcauccacgcccaccaccaguggaugaccacggaggacaugcuguccgucuggaaccggguguggaucgaggagaaccccuggauggaggacaagacccacgugagcuccuggggcgacguccccuaccugggcaagcgcgaggaccaguggugcggcagccucaucgggcugaccgcccgcgcgaccugggccacgaacauccagguggccaucaaccaggugcggcgccugcucggcaacgagaacuaccuggacuacaugaccuccaugaagcgguucaagaacgagagcgacccggagggggcccugugguga

SEQ ID NO: 8799 - RNA, 9879 nt, Artificial Sequence
  derived and/or modified CDS sequence (opt1) from DENV-1__EU482537__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucauccagaacggccggcugaucacggccaacccgaucgugaccgacaaggagaagcccgugaacaucgaggccgagccgcccuucggggaguccuacaucgucaucggcgugggcgagaaggcgcugaagcucagcugguucaagaagggguccagcaucggcaagauguucgaggccaccgcccgcggggcccggcgcauggccauccugggcgacaccgcgugggacuucggguccaucggcggcguguucacgagcgucgggaagcuggugcaccagaucuucggcaccgccuacgggguccuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggugggcauccucgcccaggggaagaagaugauccggccccagcccauggagcacaaguacagcuggaaguccuggggcaaggcgaagaucaucggcgccgacguccagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggccugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacccuguggagcaacggcgugcucgaguccgagauggugauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggcaaccgggggccgucccugcgcacgaccaccgucaccggcaagaucauccacgaguggugcugccggagcugcacgcugccgccccuccgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggccgucuuccugcuccugaucauggggcagcugaccuggaacgaccucauccggcugugcaucauggugggcgccaacgcgagcgaccgcauggggaugggcacgaccuaccuggcccucauggccaccuucaagaugcgcccgauguucgccguggggcugcuguuccggcgccucaccucccgggagguccugcugcucacgaucgggcugagccugguggccuccgucgagcuccccaacagccuggaggagcugggcgacgggcucgcgaugggcaucaugauccugaagcugcucaccgacuuccagucccaccagcugugggccacccugcucagccugaccuucaucaagacgacccugucccuccacuacgccuggaagaccauggccauggugcugagcaucgugucccuguucccccucugccugagcaccacgucccagaagaccaccuggcugcccguccuccugggcagccuggggugcaagccgcucaccauguuccugaucgcggagaacaagaucuggggccgcaaguccuggccccugaacgaggggaucauggccgugggcguggucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggacgaugaagaucaaggacgaggagcgggacgacacccugaccauccugcucaaggcgacccugcuggccgucuccggcguguacccgcucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcccucgacuucaagcccgggaccagcggcucccccaucgucaaccgcgaggggaagaucgugggccuguacggcaacgggguggucacgaccagcggcaccuacgugagcgcgaucgcccaggccaaggccucccaggaggggccgcugcccgagaucgaggacgagguguuccggaagcgcaaccucaccaucauggaccugcaccccggcagcgggaagacgcggcgcuaccugccggcgaucguccgggaggccaucaagcgcaagcuccggacccugauccuggcccccacccgcgugguggccuccgagauggccgaggcgcucaagggcaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccugcggaagaacgggaagcgcgucauccagcugucccggaagaccuucgacaccgaguaccagaagacgaagaacaacgacugggacuacguggugaccaccgacaucagcgagaugggcgccaacuuccgcgcggaccgggucaucgacccgcgccggugccucaagcccgugauccugaaggacgggcccgagcgcgucauccuggccggccccaugccggugaccguggccuccgccgcccagcggcgcgggcggaucggccgcaaccacaacaaggagggcgaccaguacaucuacauggggcagccccucaacaacgacgaggaccacgcgcacuggacggaggccaagaugcugcuggacaacaucaacacccccgagggcaucauccccgcccucuucgagccggagcgggagaaguccgccgccaucgacggggaguaccgccugcgcggcgaggcgcggaagaccuucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcacguacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacaccaucgagacccucaugcugcuggcccucaucgccgugcugacgggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagacgaccaagaaggaccuggggaucggccacguggcgguggagaaccaccaccacgccaccaugcuggacgucgaccuccaccccgccuccgccuggacccuguacgccguggcgacgaccaucaucaccccgaugaugcgccacaccaucgagaacacgaccgccaacaucagccugaccgccaucgccaaccaggccgcgauccucauggggcuggacaagggcuggcccaucuccaagauggacaucggcgugccccugcucgcccuggggugcuacagccaggucaacccccugacccucacggccgccgugcugaugcugguggcgcacuacgccaucaucggcccggggcuccaggccaaggccacccgggaggcccagaagcgcaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccccugaccacccugugggagggguccccgggcaaguucuggaacaccacgaucgccgugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaucuacaagcgguccgggaucauggagguggaccgcagcgaggccaaggagggccugaagcgcggggagaccacgcgccacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucacgccgcccgagaagugcgacacccugcugugcgacaucggggagagcucccccaacccgaccaucgaggagggccggacgcuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgccgucaacaugaccucccggaugcugcugaaccgcuucacgauggcccaccgcaagcccaccuacgagcgggacguggaccucggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacgggguggucaagcugcucaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcagaaggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgcggacgacaccgccggcugggacacccgcaucaccgaggacgaccugcagaacgaggccaagaucacggacaucauggagccggagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggcccagcucauccggcagauggagagcgaggggaucuuccugcccuccgagcuggagacccccaaccucgccgagcgcgugcuggacuggcuggagaagcacggcguggagcggcucaagcgcauggccaucagcggggacgacugcgucgugaagccgaucgacgaccgguucgccacggcgcugaccgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucggccgggcccgcgugucccagggggccggcuggagccugcgggagaccgccugccucggcaagagcuacgcgcagauguggcagcugauguacuuccaccgccgggaccugcgccucgccgccaacgccaucugcuccgcggugcccgucgacugggugcccaccagccggacgaccugguccauccacgcccaccaccaguggaugaccaccgaggacaugcugagcguguggaaccgcgucuggaucgaggagaaccccuggauggaggacaagacgcacguguccagcuggggcgacgugccguaccuggggaagcgggaggaccaguggugcggcucccucaucggccugaccgcccgcgccaccugggccagcaacauccaggucgcgaucaaccaggugcgccggcugaucgggaacgagaacuaccucgacuacaugaccuccaugaagcgcuucaagaacgagggcgaccccgagggggcccugugguga

SEQ ID NO: 8800 - RNA, 9879 nt, Artificial Sequence
  derived and/or modified CDS sequence (opt1) from DENV-1__EU482538__SS-prME
agcgugaccaugcugcugaugcugaugcccaccgcccuggccuuccaccucaccacccgcggcggggagccgcacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccacccgggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgaccgcgagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccgccgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgguccacgagccuguccaugaccugcaucgccguggggcuggucacccucuaccugggcgugauggugcaggccgacagcgggugcgucaucaacuggaagggccgcgagcugaagugcgggagcggcaucuucgugaccaacgaggugcacacguggaccgagcaguacaaguuccaggcggacuccccgaagcggcucagcgccgccaucggcaaggccugggaggagggggucugcggcauccgcuccgccacccggcuggagaacaucauguggaagcagaucagcaacgagcugaaccacauccuccuggagaacgacaugaagcugaccgugguggucggggacguggcgggcauccucgcccaggggaagaagaugauccgcccccagcccauggaguacaaguacuccuggaaguccuggggcaaggccaagaucaucggcgccgacgugcagaacaccacguucaucaucgacgggcccaacacccuggagugcccggacgaccagcgggcguggaacaucugggaggucgaggacuacggcuucgggaucuucaccaccaacaucuggcugaagcuccgcgacagcuacacccaggugugcgaccaccggcugaugagcgccgccaucaaggacuccaaggccgugcacgccgacaugggcuacuggaucgagagcgagaagaacgagaccuggaagcuggcgcgcgccuccuucaucgaggucaagaccugcaucuggcccaagagccacacccucugguccaacggcgugcuggagagcgagaugaucauccccaagaucuacgggggccccaucucccagcacaacuaccggccgggguacuucacgcagaccgccggccccuggcaccuggggaagcucgagcuggacuucgaccugugcgagggcaccaccguggucguggacgagcacugcggcaaccgcgggcccagccuccggacgaccaccgugaccggcaagaucauccacgaguggugcugccgcuccugcacgcugccgccccugcgguucaagggggaggacggcugcugguacgggauggagauccgccccgucaaggagaaggaggagaaccucgugaaguccauggugagcgccggcuccggcgaggucgacagcuucucccuggggcugcucugcaucagcaucaugaucgaggaggugaugcggucccgcuggagccggaagaugcugaugaccggcacccuggccguguucuuccuccugaucauggggcagcugaccuggaacgaccucauccgccugugcaucauggucggcgcgaacgccuccgaccgcauggggaugggcacgaccuaccuggcccucauggccaccuucaagaugcggcccauguucgccgugggccugcuguuccgccggcucaccagccgcgaggugcugcugcucacgaucgggcugucccuggucgcgagcguggagcucccgaacucccuggaggagcugggcgacgggcucgccaugggcaucaugauccugaagcugcucaccgacuuccagagccaccagcugugggccacccugcucucccugaccuucauccggacgaccuucagccugcacuacgccuggaagaccauggcgaugguccucuccaucgugagccuguucccccugugccucuccaccacgagccagaagaccaccuggcugcccgugcugcucggcucccuggggugcaagccccugaccauguuccucaucgccgagaacaagaucuggggccgcaagagcuggccgcugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccccuguccaucccggccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagccguccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcuggacuucaagccggggaccagcggcagccccaucgugaaccgcgaggggaagaucgugggccucuacggcaacggggucgugacgaccuccggcaccuacgugagcgccaucgcccagaccaaggccucccaggaggggccccugcccgagaucgaggacgaggucuuccggaagcgcaaccugacgaucauggaccuccacccgggcagcgggaagacccggcgcuaccugcccgcgaucgugcgggaggccaucaagcgccgccugcggacccucauccuggcccccacccgcguggucgccuccgagauggccgaggcgcugaagggcaugccgauccgguaccagacgaccgccgucaagagcgagcacaccggcaaggagaucguggaccucaugugccacgccaccuucacgaugcgccugcugucccccguccgggugcccaacuacaacaugaucaucauggacgaggcccacuucaccgaccccagcuccaucgccgcgcgcggguacaucagcacccgggugggcaugggggaggccgccgccaucuucaugaccgccacgccgcccggcuccgucgaggcguucccccagagcaacgccgugauccaggacgaggagcgcgacauccccgagcgguccuggaacagcggguacgaguggaucaccgacuucccgggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgccaacuuccgggcggaccgcgugaucgacccccggcgcugccugaagcccgugauccucaaggacgggccggagcgggucauccuggccggccccaugcccgugacggucgccuccgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacaccccggagggcaucauccccgcccuguucgagcccgagcgggagaaguccgccgccaucgacggggaguaccgccuccggggcgaggcgcgcaagaccuucguggagcugaugcggcgcggggaccugcccguguggcucagcuacaaggucgccuccgagggcuuccaguacagcgaccggcgcuggugcuucgacggcgagcggaacaaccaggugcuggaggagaacauggacguggagaucuggacgaaggagggggagcgcaagaagcugcggccgcgcuggcucgacgcccggaccuacuccgacccccuggcccugcgcgaguucaaggaguucgccgcgggccggcgcagcgucuccggggaccucauccuggagaucggcaagcugccccagcaccucacccagcgggcccagaacgcccuggacaaccuggugaugcuccacaacagcgagcagggcgggcgcgccuaccggcacgcgauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggccuccgucgagccgcacuggaucgcggccagcaucauccuggaguucuuccucauggugcugcugauccccgagcccgaccggcagcgcacgccccaggacaaccagcucgccuacguggucaucgggcugcuguucaugauccucacgguggccgccaacgagaugggccugcuggagaccaccaagaaggaccucgggaucggccacguggcggucgagaaccaccaccacgccgccaugcuggacguggaccugcacccggccuccgccuggacccucuacgcgguggccacgaccaucaucacccccaugaugcgccacaccaucgagaacacgaccgccaacaucagccugaccgccaucgccaaccaggcggccauccugauggggcucgacaagggcuggcccaucuccaagauggacaucggcgucccgcugcuggcccucgggugcuacagccaggugaacccccugacccugacggccgcggugcucaugcuggucgcccacuacgccaucaucggccccgggcugcaggccaaggccacccgggaggcgcagaagcgcaccgccgccggcaucaugaagaaccccaccguggacgggaucguggccaucgaccucgacccggucguguacgacgccaaguucgagaagcagcugggccagaucaugcugcucauccugugcacgucccagauccugcucaugcggaccaccugggcgcugugcgagagcaucacccuggccacgggcccccucaccacccugugggaggggucccccggcaaguucuggaacaccacgaucgccgugagcauggccaacaucuuccgcgggagcuaccuggccggcgcgggccucgccuucucccugaugaagucccucgggggcgggcggcgcgggaccggggcccagggcgagacccucggcgagaaguggaagcggcagcugaaccagcuguccaagagcgaguucaacaccuacaagcgcuccgggaucauggaggucgaccggagcgaggccaaggagggccucaagcgcggggagacgaccaagcacgcggugucccggggcaccgccaagcugcgcugguucguggaccggaaccuggucaagcccgaggggaaggugaucgaccugggcugcggccgcgggggcuggagcuacuacugcgccgggcucaagaaggugaccgaggucaagggcuacacgaagggcgggccgggccacgaggagcccauccccauggccaccuacggguggaaccuggugaagcugcacuccggcaaggacguguucuucaucccgcccgagaagugcgacacccuccugugcgacaucggggagagcucccccaaccccaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccccugucccgcaacagcacccacgagauguacuggguguccugcgggaccggcaacaucgucagcgccgugaacaugaccucccgcaugcuccugaaccgguucacgauggcgcaccgcaagcccaccuacgagcgggacguggaccugggggccggcacccgccacgucgccguggagccggagguggccaaccucgacaucaucggccagcggaucgagaacaucaagcacgagcacaagagcaccuggcacuacgacgaggacaaccccuacaagacgugggccuaccacggguccuacgaggucaagcccagcggcagcgcguccagcauggugaacggggucgugaagcugcugaccaagcccugggacgugaucccgauggucacccagaucgccaugaccgacacgacccccuucggccagcagcgcguguucaaggagaagguggacacccggacccccaaggccaagcgcgggacggcccagaucauggaggucaccgccaaguggcucuggggcuuccugucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcuccacaagcaggggaagugcgccacgugcgucuacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggccaagaucacggacaucauggagcccgagcacgcccugcuggcgaaguccaucuucaagcucaccuaccagaacaaggugguccgcgugcagcggcccgccaagaacgggaccgugauggacgucaucagccgccgggaccagcgcggcuccggccaggugggcaccuacggccugaacacguucaccaacauggaggcccagcugauccggcagauggagagcgaggggaucuucuccccgagcgagcucgagacccccaaccuggccggccgcgugcuggacuggcucgagaagcacggggucgagcggcugaagcgcauggccaucuccggcgacgacugcguggugaagcccaucgacgaccgguucgcgaccgcccugacggcccucaacgacauggggaagguccgcaaggacaucccccagugggagccgagcaagggcuggaacgacuggcagcagguccccuucugcagccaccacuuccaccagcugaucaugaaggacggccgggagaucgugguccccugccgcaaccaggacgagcugguggggcgggcccgcgugucccagggcgccggguggagccuccgggagaccgcgugccugggcaaguccuacgcccagauguggcagcugauguacuuccaccgccgggaccuccgccuggccgccaacgcgaucugcagcgccguccccguggacugggugccgaccucccggaccacguggagcauccacgcccaccaccaguggaugaccaccgaggacaugcuguccgucuggaaccgcguguggaucgaggagaaccccuggauggaggacaagacccacgugagcuccugggaggacguccccuaccucgggaagcgcgaggaccaguggugcggcagccugaucggccugacggcccgggccaccugggcgaccaacauccagguggccaucaaccaggugcgccggcuccuggggaacgagaacuaccuggacuacaugaccuccaugaagcgcuucaagaacgagagcgaccccgagggcgcccucugguga

SEQ ID NO: 8801 - RNA, 9879 nt, Artificial Sequence
  derived and/or modified CDS sequence (opt1) from DENV-1__EU482539__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcacccugcagauccugcucaugcgcaccaccugggcgcugugcgaguccaucacgcuggccaccgggccccucaccacccugugggagggcagcccggggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcugagcaaguccgaguucaacacguacaagcggagcggcaucauggaggucgaccgcuccgaggccaaggaggggcucaagcggggcgagaccaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugacggaggucaagggguacaccaagggcggccccgggcacgaggagcccaucccgauggccaccuacggcuggaaccuggugaagcugcacagcgggaaggacguguucuucaucccgcccgagaagugcgacacccuccugugcgacaucggcgaguccagccccaacccgacgaucgaggaggggcgcacccugcggguccucaagaugguggagcccuggcugcgcggcaaccaguucugcaucaagauccugaaccccuacaugcccuccguggucgagacccucgagcagaugcagcggaagcacggcgggaugcuggugcgcaacccgcugagccggaacuccacccacgagauguacugggugagcugcggcaccgggaacaucgucuccgccgugaacaugacgagccgcaugcuccugaaccgcuucaccauggcgcaccggaagcccaccuacgagcgcgacguggaccugggcgccggcacccggcacgucgccguggagcccgagguggccaaccucgacaucaucgggcagcgcaucgagaacaucaagcacgagcacaaguccacguggcacuacgacgaggacaaccccuacaagaccugggccuaccacggcagcuacgaggucaagccguccgggagcgcguccagcauggugaacggcgucgugaagcugcugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcucuggggcuuccugagccgcaacaagaagccccggaucugcacccgcgaggaguucacgcggaaggugcgcuccaacgcggccaucggggccguguucgucgacgagaaccaguggaacagcgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcguggagggggagggccuccacaagcugggguacauccugcgcgacaucuccaacauccccggcggcaacauguacgccgacgacaccgccgggugggacacccggaucacggaggacgaccuccagaacgaggcccgcaucaccgacaucauggagccggagcacgcccugcuggccaagagcaucuucaagcucaccuaccagaacaaggugguccgcgugcagcggcccgccaagaacggcaccgugauggacgucaucucccgccgggaccagcgcgggagcggccaggugggcacguacgggcugaacaccuucaccaacauggaggcccagcugauccggcagauggaguccgagggcaucuucagccccuccgagcucgagacccccaaccuggccgagcgcgugcuggacuggcucgagaaguacggggucgagcggcugaagcgcauggccaucagcggcgacgacugcguggugaagccgaucgacgaccgguucgcgacggcccugaccgcccucaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcugguggggcgggcccgcgugucccagggcgccggguggagccuccgggagaccgcgugccugggcaagagcuacgcccagauguggcagcugauguacuuccaccgccgggaccuccgccuggccgccaacgcgaucugcuccgccguccccguggacuggauccccaccagccggacgaccugguccauccacgcccaccaccaguggaugaccaccgaggacaugcugagcguguggaaccgcgucuggaucgaggagaaccccuggauggaggacaagacgcacaucuccagcuggggcgacgugccguaccucggcaagcgcgaggaccaguggugcggcucccugaucgggcugaccgcccgggccaccugggcgaccaacauccagguggccaucaaccagguccgccggcucaucggcaacgagaacuaccuggacuacaugaccagcaugaagcgcuucaagaacgaguccgaccccgagggggcccugugguga

SEQ ID NO: 8802 - RNA, 9879 nt, Artificial Sequence
  derived and/or modified CDS sequence (opt1) from DENV-1__KP188539__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacccggaccgagaccuggaugagcagcgagggcgccuggaagcagauccagaagguggagaccugggcccugcggcacccgggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaucaucacgccccaggcgcccaccagcgagauccagcugacggacuacggggcccucacccuggacugcagcccccggaccggccuggacuucaacgagauggugcuccugaccaugaaggagaaguccuggcuggugcacaagcagugguuccucgaccugccgcugcccuggacguccggggccagcaccagccaggagaccuggaaccgccaggaccuccuggucaccuucaagacggcccacgccaagaagcaggagguggugguccugggcucccaggagggcgcgaugcacaccgcccucaccggggccaccgagauccagacgagcggcaccaccaccaucuucgccgggcaccugaagugccggcugaagauggacaagcucacgcugaagggcauguccuacgugaugugcaccgggagcuucaagcuggagaaggagguggccgagacccagcacggcaccguccugguccaggugaaguacgagggcacggacgcgcccugcaagauccccuuccucacccaggacgagaagggggucacccagaacggccgccugaucaccgccaacccgaucgugacggacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacaccgccugggacuucggguccaucggcggccuguucacgagcguggggaagcucauccaccaggucuucggcaccgcguacggggugcuguucuccggcgugagcuggaccaugaagaucgggaucggcauccugcucaccuggcugggccugaacucccgcagcacgucccucagcaugaccugcaucgccgucgggauggugacccuguaccugggcgugaugguccaggccgacuccgggugcgugaucaacuggaagggccgcgagcucaagugcgggagcggcaucuucgugaccaacgagguccacacguggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacaccacguucaucaucgacgggcccgacaccccggagugccccgacgaccagcgggccuggaacaucugggaggucgaggacuacggcuucgggaucuucaccaccaacaucuggcugaagcugcgcgacagccacacgcagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacccuguggagcaacggcguccucgaguccgagauggugauccccaagaucuacgggggcccgaucagccagcacaacuaccggcccggguacuucacgcagaccgccggccccuggcaccuggggaagcuggagcucgacuucgaccugugcgagggcaccaccguggucguggacgagcacugcggcuaccgcgggccgucccugcggacgaccaccgugaccggcaagaucauccacgaguggugcugccgcagcugcacgcugccgccccugcgguuccgcggggaggacggcugcugguacgggauggagauccggcccgucaaggagaaggaggagaaccuggugcgcuccauggugagcgcgggcuccggcgagauggacagcuucagccucgggauccugugcgucuccauccugaucgaggaggugaugcggagccgcuggucccggaagaugcucaugaccggcacccuggccguguuccugcuccugaucauggggcagcugaccuggaacgaccucauccgccugugcaucauggucggcgccaacgccagcgaccgcauggggaugggcacgaccuaccuggcccucauggcgaccuucaagaugcggccgauguucgccgugggccugcuguuccgccggcucaccucccgcgaggugcugcugcucacggucgggcugagccugguggccuccgucgagcuccccaacagccuggaggagcugggcgacgggcucgccaugggcaucaugaugcugaagcugcucaccgacuuccagccccaccagcuguggaccacccugcucucccugacguucauccggaccagccugucccucgacuacgccuggaagaccauggcgauggcccugagcaucgugucccuguucccccucugccugagcaccacgucccagaagaccaccuggcugccggugcuccugggcagcuucgggugcaagccccugaccauguuccucaucacggagaacaagaucuggggccgcaaguccuggcccaucaacgaggggaucauggccgucggcaucgugagcauccugcuguccagccuccugaaggacgacgugccccuggccgggccgcucaucgcgggcggcaugcugaucgccugcuacgucaucagcggguccagcgccgaccugucccucgagaaggccgccgaggugagcugggaggaggaggcggagcacuccggcaccagccacaacauccugguggagguccaggacgacgggaccaugaagaucaaggacgaggagcgggacgacacccugaccauccuccugaaggccacgcugcucgccguguccggcguguaccccaugagcauccccgccacccuguucgucugguacuucuggcagaagaagaagcagcgcuccggggugcugugggacacccccagcccgcccgagguggagcgggccguccuggacgacggcaucuaccgcauccuccagcggggccugcuggggcgcucccaggugggcgugggggucuuccaggacggcguguuccacaccauguggcacgugacgcgcggggcgguccucauguaccagggcaagcgccuggagcccagcugggccuccgugaagaaggaccugaucagcuacggcgggggcuggcgguuccagggguccuggaacaccggcgaggaggugcaggucaucgccguggagcccgggaagaacccgaagaacgugcagaccacccccggcacguucaagacccccgagggcgaggucggggccaucgcccucgacuucaagcccggcaccagcggguccccgaucgugaaccgcgagggcaagaucgugggccuguacgggaacggcgucgugaccacgagcgggaccuacguguccgcgaucgcccaggccaaggccacccaggagggcccccugcccgagaucgaggacgaggucuucaagaagcggaaccucaccaucauggaccugcacccggggagcggcaagacgcgccgguaccugcccgccaucgugcgcgaggcgaucaagcggaagcuccgcacccugauccuggcccccacccgcguggucgccagcgagauggccgaggcgcucaagggcaugcccauccgguaccagaccacggccgugaaguccgagcacaccgggcgcgagaucguggaccugaugugccacgccaccuucaccaugcggcugcucagcccgguccgcgugcccaacuacaacaugaucaucauggacgaggcccacuucacggaccccgccuccaucgcggcccggggcuacaucagcacccgcguggggaugggcgaggccgccgccaucuucaugaccgcgacgccgcccggguccgucgaggccuucccccagagcaacgccgugauccaggacgaggagcgggacauccccgagcgcuccuggaacagcggcuacgacuggaucacggacuuccccggcaagaccgugugguucguccccuccaucaagagcgggaacgacaucgccaacugccugcggaagaacggcaagcgcgugauccagcugucccggaagaccuucgacaccgaguaccagaagacgaagaacaacgacugggacuacguggucaccaccgacaucagcgagaugggggccaacuuccgcgcggaccgggugaucgacccccgccggugccucaagcccgugauccugaaggagggccccgagcgcgucauccuggccgggccgaugcccgugaccgucgccuccgccgcgcagcggcgcggccggaucggccgcaaccagaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgcgaucgacggcgaguaccggcugcgcggggaggcccggaagaccuucguggagcugaugcgccggggcgaccuccccguguggcuguccuacaaggucgccagcgagggcuuccaguacuccgaccgccgguggugcuucgacggggagcgcaacaaccaggugcuggaggagaacauggacguggagaucuggaccaaggagggcgagcggaagaagcuccgcccccgguggcuggacgcccgcacguacagcgacccgcuggcccuccgggaguucaaggaguucgcggccgggcgccgguccgucagcagcgaccugauccuggagaucggcaagcucccccagcaccugacccugcgcgcccagaacgcccucgacaaccuggugaugcugcacaacuccgagcagggcgggaaggccuaccggcacgcgauggaggagcuccccgacaccaucgagacccugaugcugcucgcccugaucgccgugcugaccggcggggucacccucuucuuccugagcggcaaggggcugggcaagaccuccaucggccuccugugcgugauggccagcuccgcgcugcucuggauggccagcguggagccccacuggaucgccgccuccaucauccuggaguucuuccugaugguccuccugaucccggagcccgaccgccagcggacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccaccaugcucgacgucgaccugcgcccggccagcgcguggacccuguacgccguggccacgaccgugaucacccccaugaugcggcacaccaucgagaacacgaccgccaacaucucccucaccgccaucgcgaaccaggccgccauccugauggggcuggacaagggcuggcccaucagcaagauggacaucggcgucccccuccuggcccuggggugcuacucccaggugaacccgcucacccugacggccgcggugcugaugcucgucgcccacuacgccaucaucggccccgggcugcaggccaaggcgacccgcgaggcccagaagcgcaccgccgccggcaucaugaagaaccccaccguggacgggaucgugacgaucgaccuggaccccgucguguacgacgccaaguucgagaagcagcucggccagaucaugcugcugauccucugcaccagccagauccugcugaugcggaccaccugggcgcucugcgaguccaucacgcuggccaccggcccgcugaccacccucugggaggggagccccggcaaguucuggaacacgaccaucgccguguccauggccaacaucuuccgcgggagcuaccuggccggcgcgggccuggccuucucccucaugaagucccucgggggcgggcggcgcgggaccggggcccagggcgagacccugggcgagaaguggaagcggcagcucaaccagcuguccaagagcgaguucaacacguacaagaaguccgggaucauggaggucgaccgcuccgaggccaaggagggccugaagcgcggggagaccaccaagcacgccgugagccgcggcaccgcgaagcugcggugguucguggagcgcaaccucgucaagcccgaggggaaggugaucgaccugggcugcggccgcggcgggugguccuacuacugcgccgggcugaagaaggugacggaggucaagggguacaccaagggcgggcccggccacgaggagccgauccccauggccaccuacggguggaaccucgugaagcugcacagcggcaaggacguguucuucacgccgcccgagaagugcgacacccugcucugcgacaucggggaguccagcccgaaccccacgaucgaggagggccgcacccugcggguccugaagaugguggagcccuggcuccgcgggaaccaguucugcaucaagauccugaaccccuacaugccguccguggucgagacccuggagcagaugcagcggaagcacggcggcaugcucgugcgcaacccccugagccggaacuccacccacgagauguacugggugagcugcgggacgggcaacaucgucuccgccgugaacaugaccagccgcaugcugcucaaccgguucaccauggcgcaccgcaagcccaccuacgagcgcgacguggaccugggggccggcacgcggcacgucgccguggagcccgagguggccaaccuggacaucaucggccagcgcaucgagaacaucaagaacgagcacaaguccaccuggcacuacgacgaggacaacccguacaagaccugggccuaccacgggagcuacgaggucaagcccuccggcagcgcguccagcauggugaacggggucgugcggcuccugaccaagcccugggacgugauccccauggucacgcagaucgccaugaccgacaccaccccguucggccagcagcgcguguucaaggagaagguggacacgcggacgccccgggccaagcgggggaccgcccagaucauggaggucaccgccaaguggcuguggggcuuccucucccgcacgaagaagccccggaucugcacccgcgaggaguucacccggaaggugcgcagcaacgcggccaucggcgccguguucgucgacgagaaccaguggaacagcgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccggcgggaacauguacgccgacgacacggccgggugggacacccggaucaccgaggacgaccugcagaacgaggccaagaucaccgacaucauggagcccgagcacgcccuccuggcgacgagcaucuucaagcugaccuaccagaacaaggugguccgcgugcagcgccccgccaaguccgggaccgugauggacgucaucagccggcgcgaccagcggggcuccggccaggugggcaccuacggccucaacacguucaccaacauggaggugcagcugauccgccagauggagagcgaggggaucuucucccccagcgagcuggagaccccgaaccucgccaagaagguccuggacuggcuggagaagcacggcgccgagcggcucaagcgcauggccaucuccggggacgacugcguggugaagcccaucgacgaccgguucgcgaccgcccugacggcccugaacgacaugggcaagguccgcaaggacaucccccagugggagcccagcaagggguggaacgacuggcagcaggucccguucugcucccaccacuuccaccagcucaucaugaaggacggccgggagaucgugguccccugccgcaaccaggacgagcuggugggccgggcccgcgugagccagggggccggcuggucccugcgggagaccgcgugccucggcaagagcuacgcccagauguggcagcugauguacuuccaccgccgggaccugcgccucgccgccaacgccaucugcagcgcgguccccguggacugggugcccaccucccggaccaccuggagcauccacgcccaccaccaguggaugacgaccgaggacaugcuguccgucuggaaccgcguguggaucgaggagaacccguggauggaggacaagacccacgugagcuccugggaggagguccccuaccugggcaagcgggaggaccaguggugcgggagccucaucggccugaccgcccgcgccacgugggcgaccaacauccagguggccaucaaccaggugcgccggcugaucggcaacgagaacuaccucgacuacaugaccuccaugaagcgcuucaagaacgagagcgaccccgagggggcccugugguga

SEQ ID NO: 8803 - RNA, 9879 nt, Artificial Sequence
  derived and/or modified CDS sequence (opt1) from DENV-1__KP188540__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcaugcugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgcgacgcuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgggagggcaagaucgucgggcuguacggcaacgggguggugaccaccagcggcacguacgucuccgccaucgcccaggccaaggcgagccaggaggggccccugcccgagaucgagaacgagguguucaagaagcgcaaccucaccaucauggaccugcacccgggcagcggcaagacccggcgcuaccugcccgccaucgugcgggaggccaucaagcgcaagcuccgcacccugauccuggcccccacgcgggucguggcguccgagauggccgaggcccucaaggggaugcccauccgcuaccagaccaccgccgucaagagcgagcacaccggccgggagaucgucgaccugaugugccacgccacguucaccaugcgccugcucuccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccucaagcccgucauccugaaggacgggcccgagcgggugauccuggccggcccgaugcccgucaccguggcgagcgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggaccuacuccgacccgcuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccggcggggccacccucuucuuccugagcggcaagggccuggggaagaccuccaucggccuccugugcgugacggccagcuccgcccugcucuggauggccagcgucgagccccacuggaucgcggccuccaucauccuggaguucuuccugauggugcuccugaucccggagcccgaccggcagcgcacgccccaggacaaccagcuggccuacguggucaucgggcuccuguucaugauccugaccguggccgccaacgagaugggccuccuggagaccacgaagaaggaccuggggaucggcuacguggcggccgagaaccaccagcacgccaccaugcucgacgucgaccugcacccggccagcgccuggacccuguacgcgguggccaccacggugaucacccccaugaugcggcacaccaucgagaacaccacggccaacaucucccucaccgccaucgccaaccaggcggccauccugaugggccuggacaagggguggcccaucagcaagauggacaucggcgucccccuccuggcccuggggugcuacucccaggugaacccgcucacccugaccgccgcggugcugaugcucgucgcccacuacgccaucaucggccccgggcugcaggccaaggccacgcgcgaggcgcagaagcgcaccgccgccggcaucaugaagaaccccaccguggacggcaucguggccaucgaccuggaccccgucguguacgacgccaaguucgagaagcagcucgggcagaucaugcugcugauccucugcaccagccagauccugcugaugcggacgaccugggcgcucugcgaguccaucacccuggccaccggcccgcugacgacccucugggaggggagccccggcaaguucuggaacaccaccaucgccguguccauggccaacaucuuccgcggcagcuaccuggccggggcgggccuggccuucucccucaugaagucccucgggggcgggcggcgcgggacgggcgcccagggggagacccugggcgagaaguggaagcggcagcucaaccagcuguccaagagcgaguucaacaccuacaagcgcagcgggaucauggaggucgaccgguccgaggccaaggagggccugaagcgcggggagaccacgaagcacgcggugagccggggcaccgccaagcuccgcugguucguggagcggaaccuggucaagcccgagggcaaggugaucgaccuggggugcggccgcgggggcugguccuacuacugcgccgggcugaagaaggugaccgaggucaagggcuacaccaagggcgggcccggccacgaggagccgauccccauggccaccuacggguggaaccucgugaagcugcacagcggcaaggacguguucuucaugccgcccgagaagugcgacacgcugcucugcgacaucggggaguccagcccgaaccccaccaucgaggagggccggacccugcgcguccugaagaugguggagcccuggcuccggggcaaccaguucugcaucaagauccugaaccccuacaugccguccguggucgagacccuggagcagaugcagcgcaagcacgggggcaugcucgugcggaacccccugagccgcaacuccacgcacgagauguacugggugagcugcgggaccggcaacaucgucuccgccgugaacaugaccagccggaugcugcucaaccgcuucaccauggcgcaccgcaagcccacguacgagcgggacguggaccugggcgccgggacccgccacgucgccguggagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgcguccagcauggugaacggggucgugcgccuccugacgaagcccugggacgugauccccauggucacccagaucgccaugaccgacaccacgccguucggccagcagcggguguucaaggagaagguggacacccgcacgccccgggccaagcgcggcaccacgcagaucauggaggucaccgccaaguggcuguggggguuccucucccggaacaagaagccccgcaucugcacccgggaggaguucacccgcaaggugcggagcaacgccgcgaucggcgccguguucgucgacgagaaccaguggaacagcgccaaggaggccguggaggacgagcgcuucugggaccuggugcaccgggagcgcgagcugcacaagcaggggaagugcgcgacgugcgucuacaacaugaugggcaagcgggagaagaagcucggggaguucggcaaggccaagggcucccgcgccaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgcggacgacaccgccggcugggacacccgcaucaccgaggacgaccugcagaacgaggccaagaucacggacaucauggagcccgagcacgcccuccuggccaccagcaucuucaagcugaccuaccagaacaaggugguccgcgugcagcggcccgcgaagaacgggaccgugauggacgucaucucccgccgggaccagcgcggcagcggccagguggggacguacggccucaacaccuucaccaacauggaggugcagcugauccggcagauggaguccgaggggaucuuccugcccagcgagcucgagaccccgaaccuggccgagcgcgcccuggacuggcucgagaagcacggcgccgagcggcugaagcgcauggccaucuccggggacgacugcgucgugaagcccaucgacgaccgguucgcgacggcccugaccgcccucaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcuggucggccgggcccgcgugagccagggggccggcuggucccuccgggagaccgcgugccugggcaagagcuacgcccagauguggcagcugauguacuuccaccgccgggaccuccgccuggccgccaacgcgaucugcuccgccgugcccgucgacugggugcccgccagccggaccaccuggagcauccacgcccaccaccaguggaugacgaccgaggacaugcuguccguguggaaccgcgucuggaucgaggagaacccguggauggaggacaagacccacgugagcuccugggaggaggugcccuaccucggcaagcgcgaggaccaguggugcggcagccugaucgggcugaccgcccgggcgacgugggccaccaacauccaggucgccaucaaccaggugcgccggcucaucggcaacgagaacuaccuggacuacaugaccuccaugaagcgcuucaagaacgagagcgaccccgagggggcccugugguga

SEQ ID NO: 8804 - RNA, 9879 nt, Artificial Sequence
  derived and/or modified CDS sequence (opt1) from DENV-1__KP188541__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucgggcucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguucuucaucaccgagaacaagaucugggggcggaaguccuggccccugaacgagggcaucauggccaucgggaucgugagcauccuccuguccagccugcucaagaacgacgucccccuggcgggcccgcugaucgccggcgggaugcucaucgccugcuacgugaucagcggcuccagcgccgaccugucccuggagaaggccgcggaggugagcugggagcaggaggccgagcacuccggggccagccacaacauccucgucgaggugcaggacgacggcacgaugaagaucaaggacgaggagcgcgacgacacccugaccauccugcucaaggccacccugcuggccguguccggggucuaccccaugagcauccccgcgacccucuucgugugguacuucuggcagaagaagaagcagcgguccggcgugcugugggacacccccagcccgcccgaggucgagcgcgccgugcuggacgacggcaucuaccggauccuccagcgcgggcugcugggccggucccaggugggggucggcguguuccaggacgggguguuccacaccauguggcacgucacccgcggcgccgugcugauguaccagggcaagcggcucgagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgggagggcaagaucgucgggcucuacggcaacgggguggugaccaccagcggcacguacgucuccgccaucgcccaggccaaggcgagccaggaggggccccugcccgagaucgagaacgagguguucaagaagcgcaaccugaccaucauggaccuccacccgggcagcggcaagacccggcgcuaccugcccgccaucgugcgggaggccaucaagcgcaagcugcgcacccucauccuggcccccacgcgggucguggcguccgagauggccgaggcccugaaggggaugcccauccgcuaccagaccaccgccgucaagagcgagcacaccggccgggagaucgucgaccucaugugccacgccacguucaccaugcgccugcuguccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccuccgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccugaagcccgucauccucaaggacgggcccgagcgggugauccuggccggcccgaugcccgucaccguggcgagcgccgcccagcgccggggccgcaucgggcgcaaccagaacaaggagggcgaccaguacguguacauggggcagccccugaacaacgacgaggaccacgcccacuggaccgaggccaagaugcuccuggacaacaucaacacccccgagggcaucaucccggcgcuguucgagcccgagcgggagaaguccgccgccaucgacggggaguaccgccuccggggcgaggcccgcaagacguucgucgagcugaugcggcgcggcgaccugcccguguggcucagcuacaagguggccuccgagggguuccaguacagcgaccggcgcuggugcuucgacggcgagcggaacaaccagguccuggaggagaacauggacguggagaucuggaccaaggagggggagcgcaagaagcugcggccccgcuggcucgacgcgcggaccuacuccgacccgcuggcccugcgcgaguucaaggaguucgccgccggccggcgcagcgugagcggcgaccucauccuggagaucgggaagcugccccagcaccucacccugcgggcccagaacgcgcuggacaaccucgucaugcugcacaacuccgagcagggcgggaaggccuaccgccacgccguggaggagcugcccgacaccaucgagacgcucaugcugcuggcccucaucgcggugcugaccggcggggucacccuguucuuccucagcggcaagggccuggggaagaccuccaucggccugcucugcgugacggccagcuccgcccugcuguggauggccagcguggagccccacuggaucgccgcguccaucauccucgaguucuuccugaugguccugcucaucccggagcccgaccggcagcgcacgccccaggacaaccagcuggccuacguggugaucgggcuccucuucaugauccugaccgucgccgccaacgagaugggccugcucgagaccacgaagaaggaccuggggaucggcuacguggccgcggagaaccaccagcacgccaccaugcuggacguggaccuccacccggccagcgccuggacccuguacgccgucgcgaccacggugaucacccccaugaugcggcacaccaucgagaacaccacggccaacaucucccugaccgccaucgccaaccaggccgcgauccucaugggccuggacaagggguggcccaucagcaagauggacaucggcgugccccugcucgcccuggggugcuacucccaggucaacccgcugacccucaccgccgccgugcugaugcugguggcgcacuacgccaucaucggccccgggcuccaggccaaggccacgcgcgaggcccagaagcgcaccgcggccggcaucaugaagaaccccaccgucgacggcaucguggccaucgaccuggaccccguggucuacgacgccaaguucgagaagcagcuggggcagaucaugcuccugauccugugcaccagccagauccuccugaugcggacgaccugggcccugugcgaguccaucacccucgcgaccggcccgcugacgacccugugggaggggagccccggcaaguucuggaacaccaccaucgccguguccauggccaacaucuuccgcggcagcuaccucgccggggccggccuggcguucucccugaugaagucccucgggggcgggcggcgcggcacgggcgcccagggggagacccugggcgagaaguggaagcggcagcugaaccagcucuccaagagcgaguucaacaccuacaagcgcagcgggaucauggagguggaccgguccgaggccaaggagggccugaagcgcggggagaccacgaagcacgccgucagccggggcaccgcgaagcugcgcugguucguggagcggaaccucgugaagcccgagggcaaggucaucgaccuggggugcggccgcgggggcugguccuacuacugcgccgggcugaagaaggugaccgaggugaagggcuacaccaagggcgggcccggccacgaggagccgauccccauggccaccuacggguggaaccuggucaagcuccacagcggcaaggacguguucuucaugccgcccgagaagugcgacacgcugcugugcgacaucggggaguccagcccgaaccccaccaucgaggagggccggacccuccgcgugcugaagauggucgagcccuggcugcggggcaaccaguucugcaucaagauccucaaccccuacaugccguccgugguggagacccuggagcagaugcagcgcaagcacgggggcaugcugguccggaacccccucagccgcaacuccacgcacgagauguacugggugagcugcgggaccggcaacaucguguccgccgucaacaugaccagccggaugcugcugaaccgcuucaccauggcccaccgcaagcccacguacgagcgggacguggaccucggcgcggggacccgccacguggccgucgagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccugcucacgaagcccugggacgugauccccauggugacccagaucgcgaugaccgacaccacgccguucggccagcagcgggucuucaaggagaagguggacacccgcacgccccgggccaagcgcggcaccacgcagaucauggaggugaccgccaaguggcuguggggguuccugucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccucgugcaccgggagcgcgagcugcacaagcaggggaagugcgccacgugcguguacaacaugaugggcaagcgggagaagaagcugggggaguucggcaaggcgaagggcucccgcgccaucugguacauguggcucggggcccgguuccuggaguucgaggcccugggcuucaugaacgaggaccacugguucagccgcgagaacucccucagcggggucgagggcgaggggcugcacaagcugggcuacauccuccgggacaucuccaagaucccgggcgggaacauguacgccgacgacaccgcgggcugggacacccgcaucaccgaggacgaccugcagaacgaggccaagaucacggacaucauggagcccgagcacgcccugcucgccaccagcaucuucaagcugaccuaccagaacaagguggugcgcguccagcggcccgccaagaacgggaccgugauggacgugaucucccgccgggaccagcgcggcagcggccaggucgggacguacggccugaacaccuucaccaacauggaggugcagcucauccggcagauggaguccgaggggaucuuccugcccagcgagcuggagaccccgaaccucgcggagcgcgcccuggacuggcuggagaagcacggcgccgagcggcucaagcgcauggccaucuccggggacgacugcguggucaagcccaucgacgaccgguucgccacggcgcugaccgcccugaacgacaugggcaaggugcgcaaggacaucccccagugggagcccagcaagggcuggaacgacuggcagcaggucccguucugcucccaccacuuccaccagcucaucaugaaggacgggcgggagaucgucgugcccugccgcaaccaggacgagcuggugggccgggcccgcgucagccagggggccggcuggucccugcgggagaccgccugccucggcaagagcuacgcgcagauguggcagcugauguacuuccaccgccgggaccugcgccucgccgccaacgccaucugcuccgcggugcccguggacuggguccccgccagccggaccaccuggagcauccacgcccaccaccaguggaugacgaccgaggacaugcuguccguguggaaccgcguguggaucgaggagaacccguggauggaggacaagacccacgucagcuccugggaggaggugcccuaccugggcaagcgcgaggaccaguggugcggcagccucaucgggcugaccgcccgggccacgugggcgaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8805 - RNA, 9879 nt, Artificial Sequence
  derived and/or modified CDS sequence (opt1) from DENV-1__KP188543__SS-prME
agcgugaccaugcugcucaugcugcugcccaccgcccucgccuuccaccugaccacccggggcggggagccccacaugaucgucagcaagcaggagcggggcaagagccuccucuucaagaccagcgugggggugaacaugugcacccugaucgccauggaccugggcgagcucugcgaggacaccaugaccuacaagugcccccgcaucaccgaggucgagcccgacgacguggacugcuggugcaacgccaccgacaccugggugaccuacgggaccugcagccagaccggcgagcaccggcgcgacaagcgguccgucgcccuggcgccccacgugggccuggggcucgagacgcgcaccgagaccuggaugagcuccgagggcgccuggaagcagauccagaagguggagaccugggcgcugcggcaccccggguucacggucaucgcccuguuccucgcccacgccaucggcaccagcaucacccagaaggggaucaucuucauccugcugaugcucgugacccccuccauggcgaugcgcugcgugggcaucggcaaccgggacuucgucgaggggcugagcggcgccacguggguggacgugguccuggagcacggguccugcgugaccaccauggccaagaacaagcccacccucgacaucgagcugcugaagacggaggugaccaaccccgccguccuccgcaagcugugcaucgaggccaagaucagcaacaccaccacggacucccggugccccacccagggcgaggcgacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccguccacaccggcgaccagcaccagguggggaacgagacgaccgagcacggcaccaucgccaccaucacgccccaggcccccacgagcgagauccagcugaccgacuacggggcgcucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgccaagaagcaggagguggucgugcugggcucccaggagggcgccaugcacaccgcgcucaccggggccacggagauccagaccagcggcaccaccacgaucuucgccgggcaccugaagugccggcugaagauggacaagcucacccugaagggcauguccuacgugaugugcaccgggagcuucaagcuggagaaggaggucgccgagacccagcacggcacggugcuggugcaggucaaguacgagggcaccgacgcccccugcaagauccccuuccucacccaggacgagaagggggugacccagaacggccgccugaucacggcgaacccgaucgugaccgacaaggagaagcccgucaacaucgagaccgagccgcccuucggggaguccuacaucguggugggcgccggcgagaaggcccugaagcucagcugguucaagaagggguccagcaucggcaagauguucgaggccaccgcgcgcggggcccgccggauggccauccugggcgacacggccugggacuucggguccaucggcggccuguucaccagcgucgggaagcucauccaccagguguucggcaccgccuacggggugcuguucuccggcgucagcuggaccaugaagaucgggaucggcauccugcucacguggcugggccugaacucccgcagcaccucccucagcaugaccugcaucgcgguggggauggugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggccgacuccccgaagcggcugagcgccgccaucggcaaggcgugggaggagggggugugcggcauccgcagcgccacccggcuggagaacaucauguggaagcagaucuccaacgagcucaacuacauccugcuggagaacgacaugaaguucaccgucguggugggggacgucaacggcauccucgcccaggggaagaagaugauccgcccccagcccauggagcacaaguacagcuggaaguccuggggcaaggccaagaucaucggcgccgacauccagaacacgaccuucaucaucgacgggcccgacaccccggagugccccgacgaccagcgggcguggaacaucugggagguggaggacuacggcuucgggaucuucaccacgaacaucuggcugaagcugcgcgacagccacacccagaugugcgaccaccggcucauguccgccgccaucaaggacagcaaggccgugcacgcggacaugggcuacuggaucgaguccgagaagaacgagaccuggaagcuggcccgcgccagcuucaucgaggucaagaccugcaucuggcccaagucccacacgcuguggagcaacggcgugcucgaguccgagauggugauccccaagaucuacgggggcccgaucagccagcacaacuaccggcccggguacuucacccagaccgccggccccuggcaccuggggaagcuggagcucgacuucgaccugugcgagggcaccacggucgugguggacgagcacugcggcuaccgcgggccgucccugcggaccaccaccgucacgggcaagaucauccacgaguggugcugccgcagcugcacccugccgccccugcgguuccgcggggaggacggcugcugguacgggauggagauccggcccgugaaggagaaggaggagaaccuggugcgcuccauggucagcgccggcuccggcgagauggacagcuucagccucgggauccugugcguguccauccugaucgaggaggugaugcggagccgcuggucccggaagaugcucaugaccggcacccuggcggucuuccugcuccugaucauggggcagcugacguggaacgaccucauccgccugugcaucauggugggcgccaacgccagcgaccgcauggggaugggcaccaccuaccuggcccucauggccaccuucaagaugcggccgauguucgcggugggccugcuguuccgccggcucacgucccgcgagguccugcugcucaccguggggcugagccuggucgccuccguggagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgccuggaagaccauggccauggcgcugagcaucgugucccuguucccccucugccugagcacgaccucccagaagaccaccuggcugccgguccuccugggcagcuucgggugcaagccccugacgauguuccucaucaccgagaacaagaucuggggccgcaaguccuggcccaucaacgaggggaucauggccgugggcaucgugagcauccugcuguccagccuccugaagaacgacgucccccuggccgggccgcucaucgccggcggcaugcugaucgcgugcuacgugaucagcggguccagcgccgaccugucccucgagaaggccgccgaggugagcugggaggaggaggccgagcacuccggcaccagccacaacauccuggucgaggugcaggacgacgggaccaugaagaucaaggacgaggagcgggacgacacccugacgauccuccugaaggcgacccugcucgccguguccggcgucuaccccaugagcauccccgccacccuguucgugugguacuucuggcagaagaagaagcagcgcuccggggugcugugggacacccccagcccgcccgaggucgagcgggccgugcuggacgacggcaucuaccgcauccuccagcggggccugcuggggcgcucccaggugggcgucgggguguuccaggacggcguguuccacacgauguggcacgucacccgcggggccgugcucauguaccagggcaagcgccuggagcccagcugggcguccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggccaucgcccucgacuucaagcccggcaccagcggguccccgaucgugaaccgcgagggcaagaucgucggccuguacgggaacggcguggugacgaccagcgggaccuacgucuccgccaucgcgcaggccaaggccacccaggagggcccccugcccgagaucgaggacgagguguucaagaagcggaaccucacgaucauggaccugcacccggggagcggcaagacccgccgguaccugcccgccaucgugcgcgaggccaucaagcggaagcuccgcacccugauccuggcgcccacccgcgucguggccagcgagauggccgaggcccucaagggcaugcccauccgguaccagacgaccgcggugaaguccgagcacaccgggcgcgagaucgucgaccugaugugccacgccaccuucacgaugcggcugcucagcccggugcgcgugcccaacuacaacaugaucaucauggacgaggcccacuucaccgaccccgccuccaucgccgcgcggggcuacaucagcacccgcgucgggaugggcgaggccgccgccaucuucaugaccgccacgcccccgggguccguggaggcguucccccagagcaacgccgugauccaggacgaggagcgggacauccccgagcgcuccuggaacagcggcuacgacuggaucaccgacuuccccggcaagaccgucugguucgugccguccaucaagagcgggaacgacaucgccaacugccugcggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccccgccggugccucaagcccgucauccugaaggagggccccgagcgcgugauccuggcggggccgaugcccgucacgguggccuccgccgcccagcggcgcggccggaucggccgcaaccagaacaaggagggggaccaguacaucuacaugggccagccccucaacaacgacgaggaccacgcgcacuggaccgaggccaagaugcugcuggacaacaucaacacccccgaggggaucaucccggcccucuucgagcccgagcgcgagaaguccgccgccaucgacggcgaguaccggcugcgcggggaggcgcggaagaccuucguggagcugaugcgccggggcgaccuccccgucuggcuguccuacaagguggccagcgagggcuuccaguacuccgaccgccgguggugcuucgacggggagcgcaacaaccaggugcuggaggagaacauggacgucgagaucuggacgaaggagggcgagcggaagaagcuccgcccccgguggcuggacgcccgcaccuacagcgacccgcuggcccuccgggaguucaaggaguucgccgcggggcgccgguccgugagcggcgaccugauccuggagaucggcaagcucccccagcaccugacccugcgcgcccagaacgcccucgacaaccuggugaugcugcacaacagcgagcagggcgggaaggccuaccggcacgccauggaggagcuccccgacaccaucgagacccugaugcugcucgcgcugaucgccguccugaccggcggggugacccucuucuuccuguccgggaaggggcugggcaagaccagcaucgggcuccugugcgugauggccuccagcgcccugcucuggauggcguccgucgagccccacuggaucgccgccagcaucauccuggaguucuuccugauggugcuccugaucccggagcccgaccgccagcggacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccaccaugcucgacguggaccugcgcccggccuccgccuggacgcuguacgcgguggccaccaccgucaucacccccaugaugcggcacacgaucgagaacaccaccgccaacaucagccucaccgccaucgccaaccaggcggccauccugaugggccuggacaagggcuggcccaucuccaagauggacaucggggugccccuccuggcccugggcugcuacagccaggugaacccgcucacgcugaccgccgccguccugaugcucguggcgcacuacgccaucaucgggcccggccugcaggccaaggccacccgcgaggcgcagaagcgcaccgccgccgggaucaugaagaaccccacgguggacggcaucgucaccaucgaccuggaccccgugguguacgacgccaaguucgagaagcagcucggccagaucaugcugcugauccucugcaccucccagauccugcugaugcggaccacgugggcccucugcgagagcaucacccuggcgaccgggccgcugaccacgcucugggagggcucccccgggaaguucuggaacaccaccaucgccgucagcauggccaacaucuuccgcggcuccuaccuggccggcgccgggcuggcguucagccucaugaagucccugggcgggggccggcgcgggaccggcgcccagggcgagacgcugggggagaaguggaagcggcagcucaaccagcugagcaaguccgaguucaacaccuacaagaaguccggcaucauggagguggaccgcagcgaggccaaggaggggcugaagcggggcgagaccaccaagcacgccgugucccgcgggacggccaagcugcggugguucgucgagcgcaaccucgugaagcccgagggcaagguggucgaccugggcugcgggcggggcggguggagcuacuacugcgcgggccugaagaaggugaccgaggugaagggguacaccaagggcggccccgggcacgaggagccgauccccauggccaccuacggcuggaaccucgucaagcugcacuccgggaaggacguguucuucacgccgcccgagaagugcgacacgcugcucugcgacaucggcgagagcuccccgaaccccaccaucgaggaggggcgcacccugcgggugcugaagauggucgagcccuggcuccgcggcaaccaguucugcaucaagauccugaaccccuacaugccgagcgugguggagacccuggagcagaugcagcggaagcacggcgggaugcucguccgcaacccccugucccggaacagcacgcacgagauguacuggguguccugcggcaccgggaacaucgugagcgccgucaacaugaccucccgcaugcugcucaaccgguucaccauggcccaccgcaagcccacguacgagcgcgacguggaccugggcgcgggcacccggcacguggccgucgagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgccagcuccauggugaacggcgugguccggcuccugacgaagcccugggacgugauccccauggugacccagaucgcgaugaccgacaccacgccguucgggcagcagcgcgucuucaaggagaagguggacacccggacgccccgggccaagcggggcaccgcccagaucauggaggugacggccaaguggcuguggggcuuccucagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgcggacgacacggccgggugggacacccggaucaccgaggacgaccugcagaacgaggccaagaucaccgacaucauggagcccgagcacgcccuccuggccacguccaucuucaagcugaccuaccagaacaagguggugcgcguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaccccgaaccucgccaagaaggugcuggacuggcuggagaagcacggggccgagcggcucaagcgcauggccaucagcggcgacgacugcgucgugaagcccaucgacgaccgguucgccaccgcgcugacggcccugaacgacauggggaaggugcgcaaggacaucccccagugggagcccuccaagggcuggaacgacuggcagcaggucccguucugcagccaccacuuccaccagcucaucaugaaggacggccgggagaucguggugcccugccgcaaccaggacgagcuggucgggcgggcccgcgugucccagggcgccggguggagccugcgggagaccgccugccucggcaaguccuacgcgcagauguggcagcugauguacuuccaccgccgggaccugcgccucgccgccaacgccaucugcagcgccgugcccgucgacugggugcccaccagccggaccaccugguccauccacgcgcaccaccaguggaugacgaccgaggacaugcugagcguguggaaccgcgucuggaucgaggagaacccguggauggagaacaagacccacguguccagcugggaggaggugcccuaccuggggaagcgggaggaccaguggugcggcucccucaucggccugaccgcccgcgccacgugggccaccaacauccaggucgcgaucaaccaggugcgccggcugaucgggaacgagaacuaccucgacuacaugaccagcaugaagcgcuucaagaacgaguccgaccccgagggcgcccugugguga

SEQ ID NO: 8806 - RNA, 9879 nt, Artificial Sequence
  derived and/or modified CDS sequence (opt1) from DENV-1__KP188544__SS-prME
agcgugaccaugcugcucaugcugcugcccaccgcccucgccuuccaccugaccacccggggcggggagccccacaugaucgugagcaagcaggagcggggcaagagccuccucuucaagaccuccgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgaggucgacagcuucagccucgggauccugugcguguccauccugaucgaggaggugaugcggagccgcuggucccggaagaugcucaugaccggcacccuggccgucuuccugcuccugaucauggggcagcugacguggaacgaccucauccgccugugcaucauggugggcgccaacgccagcgaccgcauggggaugggcaccaccuaccuggcccucauggcgaccuucaagaugcggccgauguucgccgugggccugcuguuccgccggcucacgugccgcgagguccugcugcucaccguggggcugucccuggucgccagcguggagcuccccaacucccuggaggagcugggcgacgggcucgccaugggcaucaugaugcugaagcugcucaccgacuuccagccccaccagcuguggaccacgcugcucagccugaccuucauccggaccucccugagccucgacuacgccuggaagaccauggcgauggcccuguccaucgugagccuguucccccucugccuguccacgaccagccagaagaccaccuggcugccgguccuccugggcuccuucgggugcaagccccugacgauguuccucaucaccgagaacaagaucuggggccgcaagagcuggcccaucaacgaggggaucauggccgugggcaucguguccauccugcugagcucccuccugaagaacgacgucccccuggccgggccgcucaucgcgggcggcaugcugaucgccugcuacgugaucagcgggagcuccgccgaccugagccucgagaaggccgccgagguguccugggaggaggaggcggagcacagcggcaccucccacaacauccuggucgaggugcaggacgacgggaccaugaagaucaaggacgaggagcgggacgacacccugacgauccuccugaaggccacccugcucgccgugagcggcgucuaccccauguccauccccgccacccuguucgugugguacuucuggcagaagaagaagcagcgcagcggggugcugugggacacccccuccccgcccgaggucgagcgggccgugcuggacgacggcaucuaccgcauccuccagcggggccugcuggggcgcagccaggugggcgucgggguguuccaggacggcguguuccacacgauguggcacgucacccgcggggcggugcucaugcaccagggcaagcgccuggagcccuccugggccagcgugaagaaggaccugaucuccuacggcgggggcuggcgguuccaggggagcuggaacaccggcgaggagguccaggugaucgccguggagcccgggaagaacccgaagaacguccagaccacgcccggcaccuucaagacccccgagggcgaggugggggccaucgcccucgacuucaagcccggcaccuccgggagcccgaucgugaaccgcgagggcaagaucgucggccuguacgggaacggcguggugacgaccuccgggaccuacgucagcgcgaucgcccaggccaaggccacccaggagggcccccugcccgagaucgaggacgagguguucaagaagcggaaccucacgaucauggaccugcacccgggguccggcaagacccgccgguaccugcccgccaucgugcgcgaggcgaucaagcggaagcuccgcacccugauccuggcccccacccgcgucguggccagcgagauggccgaggcgcucaagggcaugcccauccgguaccagacgaccgccgucaagagcgagcacaccgggcgcgagaucgucgaccugaugugccacgccaccuucacgaugcggcugcucuccccggugcgcgugcccaacuacaacaugaucaucauggacgaggcccacuucaccgaccccgccagcaucgcggcccggggcuacaucuccacccgcgucgggaugggcgaggccgccgccaucuucaugaccgcgacgcccccggggagcguggaggccuucccccaguccaacgccgugauccaggacgaggagcgggacauccccgagcgcagcuggaacuccggcuacgacuggaucaccgacuuccccggcaagaccgucugguucgugccgagcaucaaguccgggaacgacaucgccaacugccugcggaagaacggcaagcgcgugauccagcugagccggaagaccuucgacacggaguaccagaagaccaagaacaacgacugggacuacgucgugaccaccgacaucuccgagaugggggccaacuuccgcgcggaccgggugaucgacccccgccggugccucaagcccgucauccugaaggagggccccgagcgcgugauccuggccgggccgaugcccgucacgguggccagcgccgcgcagcggcgcggccggaucggccgcaaccagaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaaguccgccgcgaucgacggcgaguaccggcugcgcggggaggcccggaagaccuucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggacgaaggagggcgagcggaagaagcuccgcccccgguggcuggacgcccgcaccuacuccgacccgcuggcccuccgggaguucaaggaguucgcggccgggcgccggagcguguccggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacaccaucgagacccugaugcugcucgcccugaucgccguccugaccggcggggugacccucuucuuccugagcgggaaggggcugggcaagaccuccaucgggcuccugugcgugauggccagcuccgcgcugcucuggauggccagcgucgagccccacuggaucgccgccuccaucauccuggaguucuuccugauggugcuccugaucccggagcccgaccgccagcggacgccccaggacaaccagcuggccuacguggucaucggccuccuguucaugauccugacgguggcggccaacgagauggggcuccuggagaccaccaagaaggaccugggcaucgggcacguggccgucgagaaccaccaccacgccaccaugcucgacguggaccugcgcccggccagcgcguggacgcuguacgccguggccaccaccgucaucacccccaugaugcggcacacgaucgagaacaccaccgccaacaucucccucaccgccaucgcgaaccaggccgccauccugaugggccuggacaagggcuggcccaucagcaagauggacaucggggugccccuccuggcccugggcugcuacucccaggugaacccgcucacgcugaccgccgcgguccugaugcucguggcccacuacgccaucaucgggcccggccugcaggccaaggcgacccgcgaggcccagaagcgcaccgccgccgggaucaugaagaaccccacgguggacggcaucgucaccaucgaccuggaccccgugguguacgacgccaaguucgagaagcagcucggccagaucaugcugcugauccucugcaccagccagauccugcugaugcggaccacgugggcgcucugcgaguccaucacccuggccaccgggccgcugaccacgcucugggagggcagccccgggaaguucuggaacaccaccaucgccgucuccauggccaacaucuuccgcggcagcuaccuggccggcgcggggcuggccuucucccucaugaagucccugggcgggggccggcgcgggaccggcgcccagggcgagacgcugggggagaaguggaagcggcagcucaaccagcuguccaagagcgaguucaacaccuacaagaaguccggcaucauggagguggaccgcagcgaggccaaggaggggcugaagcggggcgagaccaccaagcacgccgugagccgcgggacggcgaagcugcggugguucgucgagcgcaaccucgugaagcccgagggcaaggugaucgaccugggcugcgggcggggcgggugguccuacuacugcgccggccugaagaaggucaccgaggugaagggguacaccaagggcggccccgggcacgaggagccgauccccauggccaccuacggcuggaaccucgugaagcugcacagcgggaaggacgucuucuucacgccgcccgagaagugcgacacgcugcucugcgacaucggcgaguccagcccgaaccccaccaucgaggaggggcgcacccugcgggugcugaagaugguggagcccuggcuccgcggcaaccaguucugcaucaagauccugaaccccuacaugccguccgucguggagacccuggagcagaugcagcggaagcacggcgggaugcucgugcgcaacccccugagccggaacuccacgcacgagauguacugggucagcugcggcaccgggaacaucguguccgccgugaacaugaccagccgcaugcugcucaaccgguucaccauggcgcaccgcaagcccacguacgagcgcgacgucgaccugggcgccggcacccggcacguggccguggagcccgaggucgccaaccuggacaucaucgggcagcgcaucgagaacaucaagaacgagcacaaguccaccuggcaccacgacgaggacaacccguacaagaccugggccuaccacggcagcuacgaggugaagcccuccgggagcgcguccagcauggucaacggcguggugcggcuccugacgaagcccugggacgucauccccauggugacccagaucgccaugaccgacaccacgccguucgggcagcagcgcguguucaaggagaaggucgacacccggacgccccgggccaagcggggcaccgcccagaucauggaggugacggccaaguggcuguggggcuuccucucccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaagaucccgggcggcaacauguacgccgacgacacggccgggugggacacccggaucaccgaggacgaccugcagaacgaggccaagaucaccgacaucauggagcccgagcacgcccuccuggcgacgagcaucuucaagcugaccuaccagaacaaggucgugcgcgugcagcgccccgccaaguccggcaccgucauggacgugaucagccggcgcgaccagcggggguccggccaggugggcaccuacgggcucaacacguucaccaacauggagguccagcugauccgccagauggagagcgagggcaucuucucccccagcgagcuggagaccccgaaccucgccaagaaggugcuggacuggcuggagaagcacggggccgagcggcucaagcgcauggccaucuccggcgacgacugcguggucaagcccaucgacgaccgguucgcgaccgcccugacggcccugaacgacauggggaaggugcgcaaggacaucccccagugggagcccagcaagggcuggaacgacuggcagcaggucccguucugcucccaccacuuccaccagcucaucaugaaggacggccgggagaucgucgugcccugccgcaaccaggacgagcugguggggcgggcccgcgucagccagggcgccggguggucccugcgggagaccgcgugccucggcaagagcuacgcccagauguggcagcugauguacuuccaccgccgggaccugcgccucgccgccaacgccaucugcuccgcggugcccguggacuggguccccaccagccggaccaccuggagcauccacgcccaccaccaguggaugacgaccgaggacaugcuguccguguggaaccgcguguggaucgaggagaacccguggauggaggacaagacccacgucagcuccugggaggaggugcccuaccuggggaagcgggaggaccaguggugcggcagccucaucggccugaccgcccgcgccacgugggcgaccaacauccagguggccaucaaccagguccgccggcugaucgggaacgagaacuaccucgacuacaugaccuccaugaagcgcuucaagaacgagagcgaccccgagggcgcccugugguga

SEQ ID NO: 8807 - RNA, 9879 nt, Artificial Sequence
  derived and/or modified CDS sequence (opt1) from DENV-1__KP188547__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacacgaugaccuacaagugcccccggaucaccgaggccgagcccgacgacgucgacugcuggugcaacgccaccgacaccugggugaccuacgggaccugcagccagaccggcgagcaccggcgggacaagcgguccguggcccuggcgccccacgucggccuggggcucgagacgcgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccauccuccgcaagcugugcaucgaggcgaagaucagcaacaccaccacggacucccggugccccacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgccaccaucacgccccaggcgcccacgagcgagauccagcugaccgacuacggggcccucacccuggacugcagcccccggaccggccuggacuucaacgagaugguccuccugacgaugaaggagaaguccuggcuggugcacaagcagugguuccucgaccugccccugcccuggaccuccggggccagcaccagccaggagaccuggaaccgccaggaccuccuggugacguucaagaccgcccacgccaagaagcaggaggucguggugcugggcucccaggagggcgcgaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggccgagacccagcacggcacggugcugguccaggugaaguacgagggcaccgacgcgcccugcaagauccccuuccucacccaggacgagaagggggugacccagaacggccgccugaucacggccaacccgaucgucaccgacaaggagaagcccgugaacaucgagaccgagccgcccuucggggaguccuacaucguggucggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccagguguucggcaccgcguacgggguccuguucuccggcgugagcuggaccaugaagaucgggaucggcauccugcucacguggcugggccugaacucccgcagcaccucccucagcaugaccugcaucgccguggggauggucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacuccccgaagcggcugagcgccgcgaucggcaaggccugggaggagggggucugcggcauccgcagcgccacccggcuggagaacaucauguggaagcagaucuccaacgagcucaacuacauccugcuggagaacgacaugaaguucaccgugguggucggggacgugaacggcauccucgcccaggggaagaagaugaucaagccccagcccauggagcacaaguacagcuggaaguccuggggcaaggccaagaucaucggcgcggacauccagaacacgaccuucaucaucgacgggcccgacaccccggagugccccgacgaccagcgcgccuggaacaucugggagguggaggacuacggcuucgggaucuucaccacgaacaucuggcugaagcugcgggacagccacacccagaugugcgaccaccgccucauguccgccgccaucaaggacagcaaggcgguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagauggucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcuaccgggggccgucccugcgcaccaccaccgugacgggcaagaucauccacgaguggugcugccggagcugcacccugccgccccugcgcuuccgcggggaggacggcugcugguacgggauggagauccgccccgugaaggagaaggaggagaaccugguccgguccauggugagcgcgggcuccggcgagguggacagcuucagccucgggauccugugcgucuccauccugaucgaggaggugaugcgcagccgguggucccgcaagaugcucaugaccggcacccuggccguguuccugcuccugaucauggggcagcugacguggaacgaccucauccggcugugcaucauggucggcgccaacgcccuggaccgcauggggaugggcaccaccuaccucgcccugauggccaccuucaagaugcgcccgauguucgccguggggcuccucuuccggcgccugacgagccgggaggugcugcuccugaccgucgggcugucccucguggccagcgucgagcugcccuccagccuggaggagcucggcgacgggcuggccaugggcaucaugaugcugaagcuccugaccgacuuccagccccaccagcuguggaccacgcuccugucccugaccuucauccgcaccagccucucccuggacuacgccuggaagaccauggcgauggcccugagcaucgugucccucuucccccugugccugagcacgaccucccagaagaccaccuggcucccggugcugcugggcagcuucgggugcaagccccucacgauguuccugaucaccgagaacaagaucuggggccggaaguccuggcccaucaacgaggggaucauggccgucggcaucgugagcauccugcucuccagccugcugaagaacgacgugccccucgccgggccgcugaucgcgggcggcaugcugaucgccugcuacgucaucagcggguccagcgccgaccucucccuggagaaggccgccgaggugagcugggaggaggaggcggagcacuccggcaccagccacaacauccugguggagguccaggacgacgggaccaugaagaucaaggacgaggagcgcgacgacacccucacgauccugcugaaggccacccuccuggccguguccggcguguaccccaugagcauccccgccacccuguucgucugguacuucuggcagaagaagaagcagcgguccggggugcugugggacacccccagcccgcccgagguggagcgcgccguccucgacgacggcaucuaccggauccugcagcgcggccugcucgggcggucccaggugggcgugggggucuuccaggacggcguguuccacacgauguggcacgugacccgcggggcgguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacgcccggcaccuucaagacccccgagggcgaggucggggccaucgcccuggacuucaagcccggcaccagcggguccccgaucgugaaccgggagggcaagaucgugggccuguacgggaacggcgucgugacgaccagcgggaccuacguguccgcgaucgcccaggccaaggccacccaggagggcacgcuccccgagaucgaggacgaggucuucaagaagcgcaaccugaccaucauggaccugcaccccgggagcggcaagacccggcgcuaccucccggccaucgugcgggaggcgaucaagcgcaagcugcggacccugauccucgcccccacgcgcguggucgccagcgagauggccgaggcgcugaagggcaugcccauccgcuaccagaccaccgccgugaaguccgagcacaccgggcgggagaucguggaccugaugugccacgccacguucaccaugcgccuccugagccccguccgggugccgaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccgcagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcucucccgcaagacguucgacaccgaguaccagaagaccaagaacaacgacugggacuacguggucaccacggacaucagcgagaugggggccaacuuccgggcggaccgcgugaucgacccgcggcgcugccugaagcccgugauccugaaggagggccccgagcgggucauccucgccgggcccaugccggugaccgucgccuccgccgcgcagcgccggggccgcaucggccggaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcccugcgcgaguucaaggaguucgcggccgggcggcgcuccgucagcggcgaccugauccucgagaucggcaagcugccgcagcaccugacccuccgggcccagaacgcccuggacaaccuggugaugcuccacaacagcgagcagggcgggaaggccuaccgccacgcgauggaggagcugcccgacaccaucgagacgcugaugcuccuggcccugaucgccgugcucaccgggggcgucacccuguucuuccuguccgggaagggccucggcaagaccagcaucgggcugcugugcgugauggccuccagcgcgcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgcggccaacgagauggggcugcuggagaccaccaagaaggaccucggcaucgggcacguggccguggagaaccaccaccacgccacgaugcuggacgucgaccugcggcccgccuccgcguggacccucuacgccguggccaccaccgugaucacgccgaugaugcgccacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgggaggcccagaagcgcacggccgccgggaucaugaagaaccccaccguggacggcaucgugaccaucgaccucgaccccgucguguacgacgccaaguucgagaagcagcugggccagaucaugcugcucauccugugcaccucccagauccugcucaugcgcacgaccugggcgcugugcgagagcaucacccuggccaccgggccccucacgacccugugggagggcuccccggggaaguucuggaacaccaccaucgccgugagcauggccaacaucuuccggggcuccuaccuggccggcgcggggcucgccuucagccugaugaagucccugggcgggggccgccgggggacgggcgcccagggcgagacccucggggagaaguggaagcgccagcugaaccagcugagcaaguccgaguucaacaccuacaagaaguccggcaucauggaggucgaccggagcgaggccaaggaggggcugaagcgcggcgagaccacgaagcacgccgugucccgggggaccgcgaagcuccgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaaccuggugaagcugcacuccgggaaggacguguucuucacgccgcccgagaagugcgacacccuccugugcgacaucggcgagagcucccccaacccgaccaucgaggaggggcggacccugcgcguccucaagaugguggagcccuggcugcggggcaaccaguucugcaucaagauccugaaccccuacaugcccagcguggucgagacgcucgagcagaugcagcgcaagcacggcgggaugcuggugcggaacccgcugucccgcaacagcacccacgagauguacuggguguccugcggcaccgggaacaucgucagcgccgugaacaugaccucccggaugcuccugaaccgcuucacgauggcgcaccggaagcccaccuacgagcgcgacguggaccugggcgccggcacccgccacgucgccguggagcccgagguggccaaccucgacaucaucgggcagcggaucgagaacaucaagaacgagcacaagagcaccuggcacuacgacgaggacaaccccuacaagacgugggccuaccacggcuccuacgaggucaagccgagcggguccgcgagcuccauggugaacggcgucgugcgccugcugaccaagcccugggacgugauccccauggucacccagaucgccaugaccgacacgacccccuucgggcagcagcggguguucaaggagaagguggacacccgcaccccgcgggccaagcgcggcacggcccagaucauggaggucaccgccaaguggcucuggggcuuccugagccggaacaagaagccccgcaucugcacccgggaggaguucacccgcaaggugcgguccaacgcggccaucggggccguguucgucgacgagaaccaguggaacagcgccaaggaggccguggaggacgagcgcuucugggaccuggugcaccgggagcgcgagcuccacaagcagggcaagugcgcgacgugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagccggagcacgcccugcuggcgaccuccaucuucaagcucaccuaccagaacaaggugguccgggugcagcgccccgccaagagcggcaccgugauggacgucaucucccgccgggaccagcgcgggagcggccaggugggcacguacgggcugaacaccuucaccaacauggaggugcagcugauccggcagauggaguccgagggcaucuucagccccuccgagcucgagacccccaaccuggccaagaagguccuggacuggcucgagaagcacggggccgagcgccugaagcggauggccaucagcggcgacgacugcguggugaagccgaucgacgaccgcuucgcgacggcccugaccgcccucaacgacauggggaagguccggaaggacaucccccagugggagcccuccaagggcuggaacgacuggcagcagguccccuucugcagccaccacuuccaccagcugaucaugaaggacggccgcgagaucguggucccgugccggaaccaggacgagcugguggggcgcgcccgggugucccagggcgccggguggagccuccgcgagaccgcgugccugggcaaguccuacgcccagauguggcagcugauguacuuccaccggcgcgaccuccggcuggccgccaacgccaucugcagcgcgguccccguggacugggugcccaccagccgcaccacgugguccauccacgcccaccaccaguggaugaccaccgaggacaugcugagcgucuggaaccggguguggaucgaggagaaccccuggauggaggacaagacccacguguccagcugggaggaggucccguaccucgggaagcgcgaggaccaguggugcggcucccugaucggccugacggcccgggccaccugggcgaccaacauccagguggccaucaaccaggugcgccgccucaucgggaacgagaacuaccuggacuacaugaccagcaugaagcgguucaagaacgaguccgaccccgagggcgcccugugguga

SEQ ID NO: 8808 - RNA, 9879 nt, Artificial Sequence
  derived and/or modified CDS sequence (opt1) from DENV-1__KP723473__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagugcgacagccgguggcuggacgcccgcaccuacagcgacccccuggcgcuccgggaguucaaggaguucgccgccgggcgccgguccgugagcggcgaccugauccuggagaucggcaagcucccccagcaccugacccugcgcgcccagaacgcccucgacaaccuggugaugcugcacaacuccgagcagggcgggaaggcguaccggcacgccauggaggagcucccggacaccaucgagacgcugaugcugcucgcccugaucgccguccugaccgggggcgugacccucuucuuccugagcgggaagggccugggcaagaccuccaucgggcuccugugcgugauggcgagcuccguccugcucuggauggccagcguggagccccacuggaucgccgccuccaucauccuggaguucuuccugauggugcuccugauccccgagcccgaccgccagcggacgccgcaggacaaccagcuggccuacgucgugaucggccuccuguucaugauccugaccguggcggccaacgagauggggcuccuggagaccaccaagaaggaccugggcaucgggcacgucguggccgagaaccaccaccacgccacgaugcucgacaucgaccugcaccccgccagcgcguggacccuguacgccguggccaccaccaucaucacgcccaugaugcgccacaccaucgagaacaccaccgccaacaucucccucacggccaucgcgaaccaggccgccauccugaugggccuggacaagggcuggccgaucagcaagauggacaucggggucccccuccuggcccugggcugcuacucccaggugaacccccucacccugaccgccgcggugcugaugcucgucgcccacuacgccaucaucgggcccggccugcaggccaaggcgacccgggaggcccagaagcgcacggccgccgggaucaugaagaacccgaccguggacggcaucguggccaucgaccuggaccccgucguguacgacgcgaaguucgagaagcagcucggccagaucaugcugcugauccucugcaccagccagauccugcugaugcgcaccacgugggcccucugcgaguccaucacccuggccaccgggccccugaccacgcucugggagggcagccccgggaaguucuggaacaccaccaucgccguguccauggccaacaucuuccggggcagcuaccuggcgggcgccgggcuggccuucucccucaugaagucccugggcgggggccgccgggggaccggcgcccagggcgagacgcugggggagaaguggaagcgccagcucaaccagcugagcaaguccgaguucaacaccuacaagcggagcggcaucauggaggucgaccgcuccgaggccaaggaggggcugaagcggggcgagaccaccaagcacgcggugagccgcgggacggccaagcuccggugguucguggagcgcaaccuggucaagccggagggcaaggugaucgaccugggcugcgggcggggcgggugguccuacuacugcgccggccugaagaaggugaccgaggucaagggguacaccaagggcggccccgggcacgaggagcccauccccauggccaccuacggcuggaacaucgugaagcuccacagcgggcgcgacguguucuucaccccgcccgagaagugcgacacgcugcugugcgacaucggcgaguccagccccaaccccaccaucgaggaggggcggacccuccgcguccugaagaugguggagccguggcugcggggcauccaguucugcaucaagauccucaaccccuacaugcccuccguggucgagacccuggagcagaugcagcgcaagcacggcgggaugcuggugcggaacccccucagccgcaacuccacgcacgagauguacugggugagcugcggcaccgggaacaucgucuccgcggugaacaugaccagccggaugcugcugaaccgcuucaccauggcccaccgcaagccgacguacgagcgggacguggaccucggcgccggcacccgccacgucgccguggagcccgagaucgccaaccuggacaucaucgggcagcggaucgagaacaucaagaacgagcacaaguccaccuggcacuacgacgaggacaaccccuacaagaccugggcguaccacggcagcuacgaggugaagcccuccgggacggccagcuccauggucaacggcgugguccgccugcucaccaagccgugggacgugauccccauggugacccagaucgccaugaccgacacgacccccuucgggcagcagcgggucuucaaggagaagguggacacccgcacgccccggccgaagcgcggcacggcccagaucauggaggugaccgccaaguggcuguggggcuuccugagccggaacaagaagccccgcaucugcacccgggaggaguucacccgcaagguccggagcaacgcggccaucggggccguguucguggacgagaaccaguggaacuccgccaaggaggccgucgaggacgagcgcuucugggaccucgugcaccgggagcgcgagcugcacaagcagggcaagugcgcgacgugcguguacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcgucgagggggagggccugcacaagcugggguacauccuccgggacaucagcaagauccccggcggcaacauguacgccgacgacaccgccgggugggacacccgcaucaccgaggacgaccugcagaacgaggccaagaucacggacaucauggagccggagcacgcccugcucgcgaccuccaucuucaagcugaccuaccagaacaagguggugcgcguccagcggcccgccaagagcggcaccgugauggacgugaucucccgccgggaccagcgcgggagcggccaggucggcacguacgggcugaacaccuucaccaacauggaggugcagcucauccggcagauggaguccgagggcaucuucagccccuccgagcuggagaacagcaaccuggccgagcgcgugcucgacuggcuggagaagcacggggucgagcggcugaagcgcauggccaucuccggcgacgacugcguggugaagcccaccgacgaccgguucgccacggcgcucaccgcccugaacgacauggggaagguccgcaaggacaucccgcagugggagcccagcaagggcuggaacgacuggcagcagguccccuucugcucccaccacuuccaccagcugaucaugaaggacggccgggagaucgugguccccugccgcaaccaggacgagcucguggggcgggcccgcgugagccagggcgccggguggagccugcgggagaccgccugccugggcaaguccuacgcgcagauguggcagcucauguacuuccaccgccgggaccugcgccuggccgccaacgccaucugcagcgccgucccggugaacugggugcccaccucccggaccacguggagcauccacgcgcaccaccaguggaugaccaccgaggacaugcucuccgucuggaaccgcguguggaucgaggagaaccccuggauggaggacaagacccacgugagcuccugggaggacguccccuaccuggggaagcgcgaggaccaguggugcggcagccugaucggccucacggcccgggccaccugggccaccaacauccagguggcgaucaaccaggugcgccggcugaucgggaacgagaacuaccuggacuacaugaccuccaugaagcgcuucaagaacgagagcgacccggagggcgcccucugguga

SEQ ID NO: 8809 - RNA, 9879 nt, Artificial Sequence
  derived and/or modified CDS sequence (opt1) from DENV-1__KT187564__SS-prME
agcgugaccaugcugcucaugcugaugcccaccgcccuggccuuccaccucaccacccggggcggggagccccacaugauggugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggggaaguccuggcucgugcacaagcagugguuccuggaccugccccuccccuggaccagcggcgccagcaccucccaggagacguggaaccggcaggaccugcuggugaccuucaagaccgcccacgcgaagaagcaggaggucguggugcucggcagccaggagggggccaugcacaccgcccugacgggcgccaccgagauccagaccuccgggaccacgaccaucuucgccggccaccugaagugccgccucaagauggacaagcugacccugaaggggaugagcuacgucaugugcaccggcuccuucaagcucgagaaggagguggcggagacgcagcacggcaccgugcugguccagaucaaguacgaggggaccgacgcccccugcaagauccccuucagcacccaggacgagaagggcgugacgcagaacgggcggcugaucaccgccaacccgaucgugaccgacaaggagaagcccgucaacaucgaggccgagccgcccuucggcgaguccuacaucgugaucggcgcgggggagaaggcccugaagcucagcugguucaagaagggcuccagcaucgggaagauguucgaggccaccgcccgcggcgcccggcgcauggcgauccugggggacacggccugggacuucggcuccaucggcgggguguucaccagcgucggcaagcuggugcaccagaucuucgggaccgccuacggcguccucuucuccggggucagcuggaccaugaagaucggcaucggcgugcugcugacguggcucgggcugaacucccgcagcaccucccugagcaugaccugcaucgccgugggccucgucacccuguaccugggggugauggugcaggccgacuccggcugcgucaucaacuggaaggggcgggagcucaagugcggcagcggcaucuucgugacgaacgaggugcacaccuggaccgagcaguacaaguuccaggcggacagcccgaagcgccuguccgccgccaucgggaaggccugggaggagggcgucugcgggauccggagcgccacccgccuggagaacaucauguggaagcagaucuccaacgagcucaaccacauccugcuggagaacgacaugaaguucaccgugguggucggcgacguggcggggauccucgcccagggcaagaagaugauccggccccagcccauggaguacaaguacagcuggaaguccuggggcaaggccaagaucaucggggccgacgugcagaacacgaccuucaucaucgacggccccaacaccccggagugccccgacgaccagcgcgcguggaacaucugggaggucgaggacuacggguucggcaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuuccggggcgaggacgggugcugguacggcauggagauccgccccgucaaggagaaggaggagaaccuggugaaguccauggugagcgccggcagcggggaggucgacuccuucagccucggccugcugugcaucuccaucaugaucgaggaggugaugcggagccgcuggucccggaagaugcucaugaucgggacccuggccguguucuuccugcucaucaugggccagcugaccuggaacgaccugauccgccucugcaucauggucggggcgaacgccagcgaccgcaugggcaugggcacgaccuaccuggcccugauggccaccuucaagaugcggccgauguucgccguggggcuccuguuccgccggcugaccucccgcgaggugcuccugcugacgaucggccucagccuggucgcguccgccgagcugcccaacagccucgaggagcugggggacggccuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcuggggagccucggcugcaagccgcugaccauguuccugaucgccgagaacaagaucugggggcggaaguccuggccccucaacgagggcaucauggccguggggaucgucagcauccugcugagcucccuccugaagaacgacgugccccuggccggcccccucaucgcgggcgggaugcugaucgccugcuacgugaucagcggcuccagcgccgaccugucccucgagaaggccgccgaggucagcugggaggaggaggcggagcacuccggggccagccacaacauccugguggaggugcaggacgacggcacgaugaagaucaaggacgaggagcgcgacgacacccugaccauccuccugaaggccacccugcucgccgucuccgggguguucccgcugagcauccccgccacccuguucgugugguacuucuggcagaagaagaagcagcgguccggcguccucugggacacgcccagcccgcccgagguggagcgcgcggugcuggacgacggcaucuaccggaucaugcagcgcgggcugcugggccggucccaggucggggugggcguguuccaggagaacgucuuccacaccauguggcacgugacccgcggggccgugcucauguaccagggcaagcggcuggagcccagcugggccuccgucaagaaggaccugaucagcuacggcgggggcuggcgccuccagggguccuggaacaccggcgaggagguccaggugaucgccgucgagcccgggaagaaccccaagaacgugcagacggcccccggcaccuucaagacccccgagggcgaggugggggcgaucgcccuggacuucaagcccggcaccagcgggucccccaucgucaaccgggagggcaagaucgugggccuguacgggaacggcguggucacgaccagcgggaccuacgugagcgccaucgcccaggcgaaggccucccaggagggcccgcuccccgagaucgaggacgagguguuccgcaagcggaaccugaccaucauggaccugcaccccgggagcggcaagacgcgccgguaccucccggccaucguccgcgaggccaucaagcggaagcugcgcacccugauccucgcccccacccgcgugguggcguccgagauggccgaggcccugaagggcaugcccauccgguaccagaccacggccgucaagagcgagcacaccgggaaggagaucguggaccugaugugccacgccaccuucaccaugcgccuccugucccccgugcgggucccgaacuacaacaugaucaucauggacgaggcgcacuucacggaccccagcuccaucgccgcccgcggcuacaucagcacccggguggggaugggcgaggccgccgcgaucuucaugaccgccacgccgcccggguccguggaggccuucccgcagagcaacgccgucauccaggacgaggagcgcgacauccccgagcgguccuggaacagcggcuacgaguggaucacggacuuccccggcaagaccgugugguucgugcccuccaucaagagcgggaacgacaucgcgaacugccugcgcaagaacggcaagcgggucauccagcucucccgcaagaccuucgacaccgaguaccagaagacgaagaacaacgacugggacuacguggugaccaccgacaucagcgagaugggggccaacuuccgggccgaccgcgucaucgacccgcggcgcugccugaagcccgugauccugaaggacggccccgagcgggugauccucgccgggcccaugccggucaccguggccuccgcggcccagcgccggggccgcaucggccggaaccacaacaaggagggggaccaguacaucuacaugggccagccccugaacaacgacgaggaccacgcccacuggacggaggccaagaugcugcucgacaacaucaacacccccgaggggaucauccccgcccuguucgagccggagcgcgagaaguccgcggccaucgacggcgaguaccgccugcgcggggaggcccgcaagaccuucgucgagcucaugcggcgcggcgaccugcccguguggcuguccuacaagguggccagcgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggacguacuccgacccccucgcgcugcgcgaguucaaggaguucgccgccgggcggcgcagcguguccggcgaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugaccggcggggugacccucuucuuccuguccgggcgcgggcugggcaagaccagcaucgggcuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucggccuccuguucaugauccugaccgucgcggccaacgagauggggcuccuggagacgaccaagaaggaccugggcaucgggcacguggccguggagaaccaccaccacgccgccaugcucgacgucgaccugcaccccgcguccgccuggacccuguacgccguggccaccacgaucaucaccccgaugaugcggcacaccaucgagaacaccacggccaacaucagccucaccgcgaucgccaaccaggccgccauccugaugggccuggacaagggcuggcccaucuccaagauggacaucggggugccccuccuggcgcugggcugcuacagccaggucaacccccucacccugaccgccgccgugcugaugcucguggcccacuacgccaucaucgggccgggccugcaggcgaaggccacgcgcgaggcccagaagcgcaccgccgccgggaucaugaagaaccccaccgucgacggcaucguggcgaucgaccuggaccccguggucuacgacgccaaguucgagaagcagcucggccagaucaugcugcugauccucugcaccucccagauccugcugaugcggacgaccugggcccucugcgagagcaucacccuggccaccgggccccugacgacccucugggagggcuccccggggaaguucuggaacaccaccaucgccgugagcauggcgaacaucuuccgcggcuccuaccuggccggcgccgggcuggccuucagccucaugaagucccugggcgggggccggcgcgggacgggcgcgcagggcgagacccugggggagaaguggaagcggcgccucaaccagcuguccaagagcgaguucaacaccuacaagcgguccggcaucauggagguggaccgcagcgaggccaaggaggggcugaagcggggcgagaccacgaagcacgccgucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagcccaucccgauggcgacguacggcuggaaccucgucaagcugcacuccgggaaggacguguucuucaucccgcccgagaagugcgacacccugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacgcuggagcagaugcagcggaagcacggcgggaugcucguccgcaacccgcugucccggaacagcacccacgagauguacuggguguccugcggcaccgggaacaucgugagcgccgucaacaugaccucccgcaugcugcucaaccgcuucaccauggcccaccggaagcccacguacgagcgcgacguggaccugggcgccggcacccggcacguggccgucgagcccgagguggcgaaccuggacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcuccugacgaagcccugggacgugauccccauggugacccagaucgccaugaccgacaccacgcccuucgggcagcagcgggucuucaaggagaagguggacacccgcaccccgaaggccaagcggggcaccgcgcagaucauggaggugacggcccgcuggcuguggggcuuccucucccggaacaagaagccccgcaucugcacccgggaggaguucacccgcaagguccggagcaacgccgccaucggggcgguguucaucgacgagaaccaguggaacuccgccaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacacggccgggugggacacccgcaucaccgaggacgaccugcagaacgaggcgaagaucaccgacaucauggagccggagcacgcccuccuggccaaggccaucuucaagcugacguaccagaacaaggucgugcgcgugcagcggcccgccaagaacggcaccgucauggacgugaucucccgccgggaccagcgcgggagcggccaggugggcaccuacgggcucaacaccuucacgaacauggaggcgcagcugauccggcagauggaguccgagggcaucuucagccccuccgagcuggagacccccaaccucgccgagcgcguccuggacuggcuggggaaguacggcguggagcggcucaagcgcauggccaucagcggggacgacugcguggucaagccgaucgacgaccgguucgccaccgcccugaccgcgcugaacgacaugggcaaggugcgcaaggacaucccccagugggagcccuccaagggcuggaacgacuggcagcagguccccuucugcagccaccacuuccaccagcucaucaugaaggacgggcgggagaucgucgugccgugccgcaaccaggacgagcuggugggccgggcccgcgucucccagggggccggcuggagccugcgggagacggccugccucggcaagagcuacgcgcagauguggcagcugauguacuuccaccgccgggaccugcgccucgccgccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacaucuccaacugggaggacgucccguaccugggcaagcgcgaggaccaguggugcggcagccucaucgggcugaccgcccgggccacgugggccaccaacauccagguggccaucaaccaggugcgccggcugaucggcaacgagaacuaccucgacuacaugaccuccaugaagcgcuucaagaacgagagcgaccccgagggggcgcugugguga

SEQ ID NO: 8810 - RNA, 9879 nt, Artificial Sequence
  derived and/or modified CDS sequence (opt1) from DENV-1__KT187560__SS-prME
agcgugaccaugcugcucaugcugcugcccaccgcccucgccuuccaccugacgacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcucccuggggugcaagccgcucaccauguuccugaucaccgagaacaagaucuggggccgcaagagcuggccccugaacgaggggaucauggccgugggcaucgucuccauccuccugagcagccugcucaagaacgacgugccccuggccgggccccugaucgccggcggcaugcucaucgcgugcuacgugaucuccgggagcuccgccgaccugagccuggagcgcgccgccgaggucuccugggaggaggaggccgagcacagcggcgcgucccacaacauccucguggaggugcaggacgacgggacgaugaagaucaaggacgaggagcgggacgacacccugaccauccugcucaaggccacccugcuggccgucagcggcguguacccgauguccauccccgccacccucuucgugugguacuucuggcagaagaagaagcagcgcagcgggguccugugggacacccccagcccgcccgagguggagcgggccgugcuggacgacggcaucuaccgcauccugcagcggggccuccuggggcgcagccaggucggcguggggguguuccaggacggcgucuuccacaccauguggcacgugacccgcggggcggugcugauguaccagggcaagcgccucgagcccuccugggccagcgucaagaaggaccugaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccucuacgggaacggcguggucaccaccuccgggacguacgugagcgcgaucgcccaggccaaggccagccaggagggcccgcugcccgagaucgaggacgagguguucaagaagcggaaccugaccaucauggaccuccaccccggguccggcaagacccgccgguaccugccggccaucguccgcgaggcgaucaagcgcaagcugcggacccucauccuggcccccacgcgcgugguggccagcgagauggccgaggcgcugaagggcaugcccauccgguaccagaccaccgccgucaaguccgagcacaccgggaaggagaucguggaccucaugugccacgccacguucaccaugcgccugcugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccuccgcaagaacggcaagcgggucauccagcugucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccucaaggacggccccgagcgggucauccuggccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgcggccaucgacggcgaguaccgccuccgcggggaggcccgcaagacguucguggagcugaugcggcgcggcgaccugcccgucuggcucuccuacaagguggccagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcccggaccuacagcgacccccuggcgcugcgcgaguucaaggaguucgccgccgggcggcgcagcguguccggcgaccucauccuggagaucggcaagcugccgcagcaccucacccugcgggcccagaacgcccuggacaaccucgugaugcugcacaacagcgagcagggcgggaaggcguaccgccacgccauggaggagcugcccgacaccaucgagacgcucaugcugcuggcccucaucgccguccugaccgggggcgugacccuguucuuccucuccgggaagggccugggcaagaccagcaucgggcugcucugcgugauggcguccagcguccugcuguggauggccuccguggagccccacuggaucgccgccagcaucauccucgaguucuuccugauggugcugcucauccccgagccggaccggcagcgcacgccccaggacaaccagcuggccuacgucgugaucggccuccucuucaugauccugaccguggcggccaacgagauggggcugcucgagaccaccaagaaggaccugggcaucgggcacgucguggccgagaaccaccaccacgccacgaugcuggacaucgaccuccaccccgccuccgcguggacccuguacgccguggccaccaccaucaucacgccgaugaugcggcacaccaucgagaacaccaccgccaacaucagccugacggccaucgcgaaccaggccgccauccucaugggccuggacaagggcuggcccaucuccaagauggacaucggggucccccugcucgcccugggcugcuacagccaggugaacccccugacccucaccgccgcggugcugaugcuggucgcccacuacgccaucaucgggccgggccuccaggccaaggcgacccgcgaggcccagaagcgcacggccgccgggaucaugaagaaccccaccguggacggcaucguggccaucgaccuggaccccgucguguacgacgcgaaguucgagaagcagcugggccagaucaugcuccugauccugugcaccucccagauccuccugaugcggaccacgugggcccugugcgagagcaucacccucgccaccgggccccugaccacgcugugggagggcuccccggggaaguucuggaacaccaccaucgccgugagcauggccaacaucuuccgcggcuccuaccucgcgggcgccgggcuggccuucagccugaugaagucccucggcgggggccggcgcgggaccggcgcccagggcgagacgcugggggagaaguggaagcggcagcugaaccagcucagcaagagcgaguucaacaccuacaagcgcuccggcaucauggaggucgaccggagcgaggccaaggaggggcugaagcgcggcgagaccaccaagcacgcggugucccgggggacggccaagcugcgcugguucguggagcggaaccuggucaagcccgagggcaaggugaucgaccucggcugcgggcgcggcggguggagcuacuacugcgccggccugaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacgcuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacgcacgagauguacuggguguccugcggcaccgggaacaucgucagcgcggugaacaugaccucccgcaugcuccugaaccgcuucaccauggcccaccggaagcccacguacgagcgcgacguggaccugggcgccggcacccggcacgucgccguggagcccgagaucgccaaccucgacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcugcugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcucuggggcuuccugagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcgucgagggggagggccuccacaagcugggguacauccugcgcgacaucagcaagaucccgggcggcaacauguacgccgacgacacggccgggugggacacccgcaucaccgaggacgaccuccagaacgaggccaagaucaccgacaucauggagcccgagcacgcccugcuggcgacguccaucuucaagcucaccuaccagaacaagguggugcggguccagcgccccgccaagagcggcaccgugauggacgugaucucccggcgcgaccagcgggggagcggccaggucggcaccuacgggcugaacacguucaccaacauggaggugcagcugauccgccagauggaguccgagggcaucuucagccccuccgagcucgagaacagcaaccuggccgagcgggugcuggacuggcucgagaagcacggggucgagcgccugaagcggauggccaucuccggcgacgacugcguggugaagccgaccgacgaccgcuucgccaccgcgcugacggcccucaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcugguggggcgcgcccgggugagccagggcgccggguggagccuccgcgagaccgccugccugggcaaguccuacgcgcagauguggcagcugauguacuuccaccggcgcgaccuccggcuggccgccaacgccaucugcagcgccguccccgugaacugggugcccaccucccgcaccaccuggagcauccacgcgcaccaccaguggaugacgaccgaggacaugcuguccgucuggaaccgcguguggaucgaggagaaccccuggauggaggacaagacccacgugagcuccugggaggacgucccguaccucgggaagcgggaggaccaguggugcggcagccugaucggccugaccgcccgcgccacgugggccaccaacauccagguggcgaucaaccaggugcggcgccucaucgggaacgagaacuaccuggacuacaugaccuccaugaagcgguucaagaacgagagcgaccccgagggcgcccugugguga

SEQ ID NO: 8811 - RNA, 9879 nt, Artificial Sequence
  derived and/or modified CDS sequence (opt1) from DENV-1__KT187561__SS-prME
agcgugaccaugcugcucaugcugcugcccaccgcccucgccuuccaccugaccacccggggcggggagccccacaugaucgugagcaagcaggagcggggcaagagccuccucuucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugccccacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcugaucacggccaacccgaucgugaccgacaaggagaagcccgugaacaucgagaccgagccgcccuucggggagagcuacaucgucaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcugcgggacuccuacacccagaugugcgaccaccgccucaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccugugguccaacggcgugcucgagagcgagaugaucauccccaagaucuacgggggcccgaucucccagcacaacuaccggcccggguacuucacccagacggcgggccccuggcaccuggggaagcuggagcucgacuucaaccugugcgagggcaccaccguggucguggacgagcacugcggcaaccgcgggccgagccugcggaccacgaccgugaccggcaagaucauccacgaguggugcugccgcuccugcacccugccgccccugcgguuccgcggggaggacggcugcugguacgggauggagauccggcccgucaaggagaaggaggagaaccuggugcgcagcaugguguccgccggcagcggcgaggucgacagcuucucccucgggcugcugugcgugagcaucaugaucgaggaggugaugcggucccgcuggagccgcaagaugcucaugacgggcacccuggccgucuucuuccugcucaucauggggcagcugaccuggaacgaccugauccggcucugcaucauggugggcgccaacguguccgaccgcauggggaugggcaccacguaccuggcccugauggcgaccuucaagaugcggccgauguucgccgucggccuccuguuccgccggcugaccagccgcgaggugcuccugcugaccaucgggcucucccuggucgccagcguggagcugcccaacucccucgaggagcugggcgacgggcuggccaugggcaucaugaugcucaagcugcugacggacuuccagagccaccagcucuggaccacccugcugucccucaccuucaucaagacgacccugagccuggacuacgccuggaagaccauggcgauggugcucuccaucgucagccuguucccccugugccucuccaccacgagccagaagaccaccuggcugcccgugcugcucggcuccuucgggugcaagccgcugaccauguuccugaucaccgagaacaagaucuggggccgcaagagcuggccccucaacgaggggaucauggccgugggcaucgucuccauccugcugagcagccuccugaagaacgacgugccccuggccgggccccucaucgccggcggcaugcugaucgcgugcuacgugaucuccgggagcuccgccgaccugagccucgagcgcgccgccgaggucuccugggaggaggaggccgagcacagcggcgcgucccacaacauccugguggaggugcaggacgacgggacgaugaagaucaaggacgaggagcgggacgacacccugaccauccuccugaaggccacccugcucgccgucagcggcguguacccgauguccauccccgccacgcuguucgugugguacuucuggcagaagaagaagcagcgcagcgggguccugugggacacccccagcccgcccgagguggagcgggccgugcucgacgacggcaucuaccgcauccugcagcggggccugcuggggcgcagccaggucggcguggggguguuccaggacggcgucuuccacaccauguggcacgugacccgcggggcggugcucauguaccagggcaagcgccuggagcccuccugggccagcgucaagaaggaccugaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccucgacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcugcccgagaucgaggacgagguguucaagaagcggaaccucaccaucauggaccugcaccccggguccggcaagacccgccgguaccugccggccaucguccgcgaggcgaucaagcgcaagcuccggacccugauccuggcccccacgcgcgugguggccagcgagauggccgaggcgcucaagggcaugcccauccgguaccagaccaccgccgucaaguccgagcacaccgggaaggagaucguggaccugaugugccacgccacguucaccaugcgccugcucagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcugucccgcaagacguucgacaccgaguaccagaagaccaagaacaacgacugggacuacguggugaccacggacaucagcgagaugggggccaacuuccgggcggaccgcgucaucgacccgcggcgcugccucaagcccgugauccugaaggacggccccgagcgggucauccuggccgggcccaugccggugaccgccgccuccgcggcccagcgccggggccgcaucggccgcaaccagaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgggagaaguccgcggccaucgacggcgaguaccgccugcgcggggaggcccgcaagacguucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccccuggcgcuccgcgaguucaaggaguucgccgccgggcggcgcagcguguccggcgaccugauccuggagaucggcaagcucccgcagcaccugacccugcgggcccagaacgcccucgacaaccuggugaugcugcacaacagcgagcagggcgggaaggcguaccgccacgccauggaggagcuccccgacaccaucgagacgcugaugcugcucgcccugaucgccguccugaccgggggcgugacccucuucuuccuguccgggaagggccugggcaagaccagcaucgggcuccugugcgugauggcguccagcguccugcucuggauggccuccguggagccccacuggaucgccgccagcaucauccuggaguucuuccugauggugcuccugauccccgagccggaccggcagcgcacgccccaggacaaccagcuggccuacgucgugaucggccuccuguuccugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgcggugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccgggaacaucgucagcgcggugaacaugaccucccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaagguggugcggguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccaccgcgcugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgccguccccgugaacugggugcccaccucccgcaccaccuggagcauccacgcgcaccaccaguggaugacgaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccacgugggccaccaacauccagguggcgaucaaccaggugcggcgccugaucgggaacgagaacuaccucgacuacaugaccuccaugaagcgguucaagaacgagagcgaccccgagggcgcccugugguga

SEQ ID NO: 8812 - RNA, 9879 nt, Artificial Sequence
  derived and/or modified CDS sequence (opt1) from DENV-1__KT187562__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaagacccugaagcuguccugguucaagaaggggagcuccaucggcaagauguucgaggcgacggcccgcggggcccggcgcauggccauccucggcgacaccgccugggacuucgggagcaucggcggcguguucaccuccguggggaagcugguccaccagguguucggcaccgcguacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgcgaucggcaaggccugggaggagggggugugcggcauccgguccgccacccgccucgagaacaucauguggaagcagaucagcaacgagcugaaccacauccugcucgagaacgacaugaaguucacggucguggugggggacgccaacggcauccugacccaggggaagaagaugauccggccccagcccauggagcacaaguacuccuggaaguccuggggcaaggccaagaucaucggcgcggacacccagaacaccacguucaucaucgacgggcccgacaccccggagugccccgacgaccagcgcgccuggaacaucugggaggucgaggacuacggcuucgggguguucaccaccaacaucuggcugaagcuccgggacuccuacacgcagaugugcgaccaccgccugaugagcgccgccaucaaggacuccaaggcggugcacgccgacaugggcuacuggaucgagagcgagaagaacgagaccuggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucaaccugugcgagggcaccaccguggucguggacgagcacugcggcaaccgcgggccgagccuccggacgaccaccgugaccggcaagaucauccacgaguggugcugccgcuccugcacgcugccgccccugcgguuccgcggggaggacggcugcugguacgggauggagauccggcccgucaaggagaaggaggagaaccucgugcgcagcaugguguccgcgggcagcggcgaggucgacagcuucucccuggggcugcucugcgugagcaucaugaucgaggaggugaugcggucccgcuggagccgcaagaugcugaugaccggcacccuggccgucuucuuccuccugaucauggggcagcugaccuggaacgaccucauccggcugugcaucauggugggcgccaacguguccgaccgcauggggaugggcacgaccuaccuggcccucauggccaccuucaagaugcggccgauguucgcggucgggcugcuguuccgccggcucaccagccgcgaggugcugcugcucacgaucgggcugucccuggucgccagcguggagcuccccaacucccuggaggagcugggcgacgggcucgccaugggcaucaugaugcugaagcugcucaccgacuuccagagccaccagcuguggaccacccugcucucccugacguucaucaagaccacccugagccucgacuacgccuggaagaccauggccauggugcuguccaucgucagccuguucccccucugccuguccacgaccagccagaagaccaccuggcugcccgugcuccugggcuccuucgggugcaagccgcugaccauguuccucaucacggagaacaagaucuggggccgcaagagcuggccccugaacgaggggaucauggcggugggcaucgucuccauccugcucagcagccugcugaagaacgacgugccccucgccgggccccugaucgccggcggcaugcugaucgccugcuacgugaucuccgggagcuccgcggaccucagccuggagcgcgccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgauguccauccccgccacccuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacgcgcggggccgugcugauguaccagggcaagcgccuggagcccuccugggcgagcgucaagaaggaccucaucuccuacggcgggggcuggcgguuccaggggagcuggaacaccggcgaggagguccaggugaucgccgucgagcccgggaagaaccccaagaacgugcagaccacccccggcacguucaagacccccgagggcgaggugggggccaucgcccuggacuucaagcccggcaccuccgggagccccaucgucaaccgcgagggcaagaucgugggccuguacgggaacggcguggucaccacguccgggaccuacgugagcgccaucgcgcaggccaaggccagccaggagggcccgcuccccgagaucgaggacgagguguucaagaagcggaaccugaccaucauggaccugcaccccggguccggcaagacccgccgguaccucccggccaucguccgcgaggccaucaagcgcaagcugcggacgcugauccucgcgcccacccgcgugguggccagcgagauggccgaggcccugaagggcaugcccauccgguaccagaccaccgcggucaaguccgagcacacggggaaggagaucguggaccugaugugccacgccaccuucaccaugcgccuccugagccccgugcgggucccgaacuacaacaugaucaucauggacgaggcccacuucaccgaccccgccuccaucgccgcgcgcggcuacaucagcacgcggguggggaugggcgaggccgccgccaucuucaugaccgccacgccgcccggguccguggaggcguucccgcagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccugcgcaagaacggcaagcgggucauccagcucucccgcaagaccuucgacaccgaguaccagaagaccaagaacaacgacugggacuacguggugacgaccgacaucagcgagaugggggccaacuuccgggccgaccgcgucaucgacccgcggcgcugccugaagcccgugauccugaaggacggccccgagcgggucauccucgcggggcccaugccggugaccgccgccuccgccgcgcagcgccggggccgcaucggccgcaaccagaacaaggagggggaccaguacaucuacaugggccagccccugaacaacgacgaggaccacgcccacuggaccgaggccaagaugcugcucgacaacaucaacacgcccgaggggaucauccccgcccuguucgagccggagcgggagaaguccgccgcgaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcccugcgcgaguucaaggaguucgcggccgggcggcgcagcguguccggcgaccugauccucgagaucggcaagcugccgcagcaccugacccuccgggcccagaacgcccuggacaaccuggugaugcuccacaacagcgagcagggcgggaaggccuaccgccacgcgauggaggagcugcccgacacgaucgagacccugaugcuccuggcccugaucgccguccucaccgggggcgugacccuguucuuccuguccgggaagggccucggcaagacgagcaucgggcugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggccgcgaacgagauggggcugcuggagaccacgaagaaggaccucggcaucgggcacgucguggccgagaaccaccaccacgccaccaugcuggacaucgaccugcaccccgccuccgccuggacccucuacgcgguggccaccacgaucaucaccccgaugaugcggcacaccaucgagaacaccacggccaacaucagccugaccgccaucgccaaccaggcggccauccugaugggccucgacaagggcuggcccaucuccaagauggacaucggggucccccugcuggcccucggcugcuacagccaggugaacccccugacccugaccgccgccgugcucaugcuggucgcgcacuacgccaucaucgggccgggccugcaggccaaggccacgcgcgaggcgcagaagcgcaccgccgccgggaucaugaagaaccccaccguggacggcaucguggccaucgaccucgaccccgucguguacgacgccaaguucgagaagcagcugggccagaucaugcugcucauccugugcaccucccagauccugcucaugcggacgaccugggcgcugugcgagagcaucacccuggccaccgggccccucacgacccugugggagggcuccccggggaaguucuggaacaccaccaucgccgugagcauggccaacaucuuccgcggcuccuaccuggccggcgcggggcucgccuucagccugaugaagucccugggcgggggccggcgcgggacgggcgcccagggcgagacccucggggagaaguggaagcggcagcugaaccagcugagcaagagcgaguucaacaccuacaagcgcuccggcaucauggaggucgaccggagcgaggccaaggaggggcucaagcgcggcgagaccacgaagcacgccgugucccgggggaccgcgaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacccugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacgcuggagcagaugcagcggaagcacggcgggaugcucgugcgcaacccgcugucccggaacagcacccacgagauguacuggguguccugcggcaccgggaacaucgucagcgccgugaacaugaccucccgcaugcugcucaaccgcuucacgauggcgcaccggaagcccaccuacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagacgugggccuaccacggcuccuacgaggugaagccgagcggguccgcgagcuccauggucaacggcgugguccggcuccugaccaagcccugggacgugauccccauggugacccagaucgccaugaccgacacgacccccuucgggcagcagcgcgucuucaaggagaagguggacacccggaccccgcgccccaagcggggcacggcccagaucauggaggugaccgccaaguggcuguggggcuuccucagccgcaacaagaagccccggaucugcacccgcgaggaguucacccggaagguccgcagcaacgccgcgaucggggccguguucguggacgagaaccaguggaacuccgccaaggaggccgucgaggacgagcgguucugggaccuggugcaccgcgagcgggagcugcacaagcagggcaagugcgccacgugcguguacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgcggacgacaccgccgggugggacacccgcaucaccgaggacgaccugcagaacgaggccaagaucacggacaucauggagcccgagcacgcccuccuggccaccuccaucuucaagcugaccuaccagaacaagguggugcggguccagcgccccgccaagagcggcaccgugauggacgugaucucccggcgcgaccagcgggggagcggccaggucggcacguacgggcucaacaccuucaccaacauggaggugcagcugauccgccagauggaguccgagggcaucuucagccccuccgagcuggagaacagcaaccucgcggagcgggugcuggacuggcuggagaagcacggggucgagcgccucaagcggauggccaucuccggcgacgacugcguggugaagccgaccgacgaccgcuucgccacggcccugaccgcgcugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcccagauguggcagcugauguacuuccaccggcgcgaccugcggcucgcggccaacgccaucugcagcgccguccccgugaacugggugcccaccucccgcaccacguggagcauccacgcccaccaccaguggaugaccaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugacggcgcgcgccaccugggccaccaacauccagguggccaucaaccaggugcggcgccugaucgggaacgagaacuaccucgacuacaugaccuccaugaagcgguucaagaacgagagcgaccccgagggcgcgcugugguga

SEQ ID NO: 8813 - RNA, 9879 nt, Artificial Sequence
  derived and/or modified CDS sequence (opt1) from DENV-1__JQ045628__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgccuucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccauccugcggaagcugugcaucgaggcgaagaucuccaacaccacgaccgacagccgcugcccgacccagggcgaggccacccucguggaggagcaggacgccaacuucgugugccggcgcacguucgucgaccggggcugggggaacggcugcgggcuguucggcaaggggucccugaucacgugcgccaaguucaagugcgugaccaagcucgagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcugaccgacuacggggcccucacgcuggacugcagcccccgcaccggccuggacuucaacgagauggugcuccugaccaugaaggagaaguccuggcugguccacaagcagugguuccucgaccugccgcugcccuggaccagcggggccagcacgucccaggagaccuggaaccggcaggaccuccuggugaccuucaagaccgcccacgccaagaagcaggagguggucgugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgugaugugcacgggguccuucaagcuggagaaggaggucgccgagacccagcacggcaccgugcucgugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcguguucaccagcguggggaagcugguccaccagaucuucggcaccgccuacggggugcuguucuccggcgugagcuggacgaugaagaucgggaucggcguccuccugaccuggcugggccucaacucccgcagcaccucccugagcaugaccugcaucgccguggggcuggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaucuggcccaagucccacacccuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacgcucgccguguuccugcugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucgggcuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccacccccgggacguucaagacccuggagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccccugccggagaucgaggacgagguguuccggaagcgcaaccugaccaucauggaccuccaccccggcagcgggaagacccggcgcuaccugcccgccaucguccgggaggcgaucaagcgcaagcugcgcacgcucauccuggccccgacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcguccccaacuacaacaugaucaucauggacgaggcccacuucaccgacccgagcuccaucgccgcccggggguacaucagcacgcgcgugggcaugggggaggcggccgccaucuucaugaccgccacgccgcccggcuccguggaggccuucccccagagcaacgcggucauccaggacgaggagcgggacaucccggagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccccgccggugccugaagccggugauccucaaggacgggcccgagcgcgugauccuggcgggccccaugcccgucaccguggccuccgccgcccagcggcgcgggcggaucggccgcaaccacaacaaggagggcgaccaguacaucuacauggggcagccgcugaacaacgacgaggaccacgcccacuggaccgaggcgaagaugcuccuggacaacaucaacacgcccgagggcaucauccccgcccuguucgagcccgagcgcgagaaguccgccgccaucgacggggaguaccggcuccgcggcgaggcccggaagaccuucgucgagcugaugcgccgcggggaccugccgguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccccagcaccucacgcagcgcgcgcagaacgcccuggacaaccuggucaugcuccacaacagcgagcagggcgggcgggccuaccgccacgccauggaggagcugccggacaccaucgagacccugaugcuccuggcgcugaucgccgugcucaccggcggggugacccuguucuuccuguccggccgggggcucggcaagacgagcaucggccugcugugcgucaucgccuccagcgugcuccuguggauggccuccguggagccccacuggaucgccgcgagcaucauccuggaguucuuccucaugguccugcugauccccgagcccgaccgccagcggaccccgcaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgcccaugaugcgccacaccaucgagaacaccaccgccaacaucagccugacggccaucgccaaccaggccgcgauccugaugggccucgacaagggcuggccgaucuccaagauggacaucggggugccccugcuggcccucggcugcuacagccaggucaacccccugacccugaccgccgccgugcucaugcugguggcgcacuacgccaucaucgggcccggccugcaggccaaggccacccgcgaggcccagaagcggacggcggccgggaucaugaagaacccgaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcucccccgggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagccggagggcaaggucaucgaccugggcugcgggcggggcggguggagcuacuacugcgccggccucaagaaggugaccgaggugaagggguacaccaagggcggccccgggcacgaggagcccauccccauggccaccuacggcuggaaccuggucaagcugcacuccgggaaggacguguucuucaucccgcccgagaagugcgacacgcuccugugcgacaucggcgagagcucccccaaccccaccaucgaggaggggcgcacccugcgggugcucaagauggucgagccguggcugcgcggcaaccaguucugcaucaagauccugaaccccuacaugcccagcgugguggagacccucgagcagaugcagcggaagcacggcgggaugcugguccgcaacccccugucccggaacagcacccacgagauguacuggguguccugcggcacggggaacaucgugagcgccgucaacaugaccucccgcaugcuccugaaccgcuucaccauggcccaccggaagccgaccuacgagcgcgacguggaccugggcgcgggcacgcggcacguggccgucgagcccgagguggccaaccucgacaucaucgggcagcgcaucgagaacaucaagcacgagcacaagagcaccuggcacuacgacgaggacaaccccuacaagaccugggccuaccacggcuccuacgaggugaagcccagcggguccgccagcagcauggucaacggcguggucaagcugcugaccaagccgugggacgugauccccauggugacgcagaucgcgaugaccgacaccacccccuucgggcagcagcgggucuucaaggagaagguggacacgcgcacccccaaggccaagcggggcaccgcccagaucauggaggugaccgccaaguggcucuggggcuuccugucccgcaacaagaagccgcggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagcccgagcacgcccugcuggccaaguccaucuucaagcucaccuaccagaacaagguggugcgcguccagcggccggcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccaaccuggccgagcgcgugcuggacuggcucgagaaguacgggguggagcggcugaagcgcauggccaucuccggcgacgacugcgucgugaagcccaucgacgaccgguucgccaccgcgcugaccgcccucaacgacauggggaaggugcgcaaggacaucccgcagugggagcccagcaagggcuggaacgacuggcagcagguccccuucugcucccaccacuuccaccagcugaucaugaaggacggccgggagaucguggugcccugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugccggucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacguccccuaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgacccggagggggcccugugguga

SEQ ID NO: 8814 - RNA, 9879 nt, Artificial Sequence
  derived and/or modified CDS sequence (opt1) from DENV-1__JQ045629__SS-prME
agcgugaccaugcugcugaugcugaugcccaccgcccuggccuuccaccucaccacccggggcggggagccccacaugauggugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagccacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcucuggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcugauccggcagauggagagcgaggggaucuucucccccagcgagcucgagacccccaaccuggccgagcgcgugcuggacuggcucgagaaguacggcguggagcggcugaagcgcauggccaucuccggggacgacugcgucgugaagccgaucgacgaccgguucgcgacggcccugaccgcccucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccucgggaagcgcgaggaccaguggugcggcagccugaucggccugaccgcccgggccaccugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8815 - RNA, 9879 nt, Artificial Sequence
  derived and/or modified CDS sequence (opt1) from DENV-1__JQ045630__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccgacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggagaaguccuggcucguccacaagcagugguuccuggaccugccccuccccuggaccagcggggccagcacgucccaggagaccuggaaccggcaggaccugcuggugaccuucaagaccgcccacgccaagaagcaggagguggucgugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgugaugugcacgggguccuucaagcucgagaaggaggucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguuccugcuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccacccccgggacguucaagacccccgagggcgaggugggcgccaucgcccuggacuucaagcccgggaccagcggcucccccaucgucaaccgcgaggggaagaucgugggccucuacggcaacgggguggucaccacgagcggcaccuacgugagcgccaucgcgcaggccaaggccucccaggaggggccgcugcccgagaucgaggacgagguguuccggaagcgcaaccugaccaucauggaccuccaccccggcagcgggaagacccggcgcuaccugccggccaucguccgggaggcgaucaagcgcaagcugcgcacgcucauccuggcccccacccgggugguggccuccgagauggccgaggcccugaagggcaugcccauccgcuaccagaccaccgcggucaagagcgagcacacgggcaaggagaucguggaccucaugugccacgccaccuucaccaugcggcugcugucccccgugcgcgucccgaacuacaacaugaucaucauggacgaggcccacuucaccgaccccagcuccaucgccgcccggggguacaucagcacgcgcgugggcaugggggaggcggccgccaucuucaugaccgccacgccgcccggcuccguggaggccuucccgcagagcaacgcggucauccaggacgaggagcgggacauccccgagcgcuccuggaacagcggguacgaguggaucaccgacuuccccggcaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgccaacuuccgcgccgaccgggucaucgacccgcgccggugccugaagcccgugauccucaaggacgggcccgagcgcgugauccuggcgggccccaugccggucaccguggccuccgccgcccagcggcgcgggcggaucggccgcaaccacaacaaggagggcgaccaguacaucuacauggggcagccccugaacaacgacgaggaccacgcccacuggaccgaggcgaagaugcuccuggacaacaucaacacgcccgagggcaucauccccgcccuguucgagccggagcgcgagaaguccgccgccaucgacggggaguaccggcuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacgcagcgcgcgcagaacgcccuggacaaccuggucaugcuccacaacagcgagcagggcgggcgggccuaccgccacgccauggaggagcugcccgacaccaucgagacccugaugcuccuggcgcugaucgccgugcucaccggcggggugacccuguucuuccuguccggccgggggcucggcaagacgagcaucggccugcugugcgucaucgccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggccacguggccguggggaaccaccaccacgcggccaugcuggacgucgaccugcaccccgccuccgccuggacccucuacgccguggcgaccaccaucaucacgccgaugaugcgccacaccaucgagaacaccaccgccaacaucagccugacggccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacccgcgaggcccagaagcggacggcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcccugugcgagagcaucacccuggcgaccgggccccucaccacgcugugggagggcuccccggggaaguucuggaacaccaccaucgccgugagcauggccaacaucuuccggggcuccuaccuggccggcgccgggcucgcguucagccugaugaagucccugggcgggggccgccgggggaccggcgcccagggcgagacgcucggggagaaguggaagcgccagcugaaccagcuguccaagagcgaguucaacaccuacaagcgguccggcaucauggagguggaccgcagcgaggccaaggaggggcucaagcggggcgagaccaccaagcacgccgucucccgcgggacggcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccaccuacggcuggaaccuggucaagcugcacuccgggaaggacguguucuucaucccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcacggggaacaucgugagcgccgucaacaugaccucccgcaugcuccugaaccgcuucaccauggcccaccggaagcccaccuacgagcgcgacguggaccugggcgcgggcacgcggcacguggccgucgagcccgagguggccaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgcgaugaccgacaccacccccuucgggcagcagcgggucuucaaggagaagguggacacgcgcaccccgaaggccaagcggggcaccgcccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggcccgcaucaccgacaucauggagccggagcacgcccugcuggccaaguccaucuucaagcucaccuaccagaacaagguggugcgcguccagcggcccgcgaagaacggcacggugauggacgugaucagccgccgggaccagcgcggguccggccaggucggcaccuacgggcugaacaccuucaccaacauggaggcccagcugauccggcagauggagagcgagggcaucuucucccccagcgagcucgagacgcccaaccuggccgagcgcgugcuggacuggcucgagaaguacgggguggagcggcugaagcgcauggccaucuccggcgacgacugcgucgugaagccgaucgacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgcggugcccgucgacuggauccccacgucccggaccaccuggagcauccacgcccaccaccaguggaugaccacggaggacaugcuguccguguggaaccgcguguggaucgaggagaaccccuggauggaggacaagacccacaucagcuccuggggcgacgucccguaccucggcaagcgcgaggaccaguggugcggcagccugaucgggcugaccgcccgggccaccugggccaccaacauccagguggcgaucaaccaggugcgccggcucaucggcaacgagaacuaccuggacuacaugacguccaugaagcgcuucaagaacgagagcgaccccgagggggcccugugguga

SEQ ID NO: 8816 - RNA, 9879 nt, Artificial Sequence
  derived and/or modified CDS sequence (opt1) from DENV-1__JQ045632__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuuccugacgcaggacgagaagggggucacccagaacggccggcucaucaccgccaacccgaucgugaccgacaaggagaagcccgugaacaucgaggccgagccgcccuucggggagagcuacaucgucaucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccaucgggaagcuggugcaccagaucuucggcaccgccuacgggguccuguucagcggcguguccuggacgaugaagaucgggaucggcgugcuccugaccuggcugggccucaacagccgcuccaccagccuguccaugaccugcaucgccgucgggcuggugacgcucuaccugggcgugaugguccaggccgacagcgggugcgugaucaacuggaagggccgggagcugaagugcggguccggcaucuucgugaccaacgagguccacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacgguggucgugggggacguggccggcauccuggcgcaggggaagaagaugauccggccccagcccauggagcacaaguacuccuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcucaagcugcgggacuccuacacccaggugugcgaccaccgccugaugagcgcggccaucaaggacuccaaggccguccacgccgacaugggcuacuggaucgagagcgagaagaacgagaccuggaagcucgcccgggcguccuucaucgaggugaagacgugcaucuggcccaagagccacacccugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcacgaccgucgugguggacgagcacugcggcaaccgggggccgagccugcgcaccaccacggucaccggcaagaucauccacgaguggugcugccgguccugcacccugccgccccugcgcuuccgcggggaggacggcugcugguacgggauggagauccgccccgugaaggagaaggaggagaaccuggucaagagcauggucuccgccggcagcggcgagguggacagcuucucccuggggcuccugugcaucagcaucaugaucgaggaggugaugcggucccgcuggagccggaagaugcugaugaccggcacgcucgccgucuucuuccugcugaucauggggcagcucaccuggaacgaccugauccgccugugcaucauggugggcgccaacgcguccgaccgcauggggaugggcaccaccuaccucgcccugauggccacguucaagaugcggccgauguucgccguggggcuccuguuccgccggcugaccagccgcgagguccugcuccugaccaucgggcugucccucguggccagcguggagcugcccaacucccuggaggagcucggcgacgggcuggcgaugggcaucaugauccugaagcuccugaccgacuuccagagccaccagcugugggccacgcuccugucccugaccuucaucaagaccaccuucagccuccacuacgccuggaagacgauggccaugguccuguccaucgugagccuguucccccucugccuguccaccaccagccagaagaccacguggcugcccguccuccugggcucccuggggugcaagccgcucaccauguuccugaucgcggagaacaagaucuggggccggcgcagcuggccccugaacgaggggaucauggccgugggcaucguguccauccuccugagcagccugcucaagaacgacgucccccuggccgggccccugaucgccggcggcaugcucaucgccugcuacgugaucuccgggagcuccgcggaccugagccuggagaaggccgccgagguguccugggaggaggaggccgagcacagcggcgccucccacaacauccucgucgaggugcaggacgacgggaccaugaagaucaaggacgaggagcgggacgacacccugaccauccugcucaaggcgacgcugcuggccgugagcggcgucuacccgcucuccauccccgccacccuguucgugugguacuucuggcagaagaagaagcagcgcagcggggugcugugggacacccccagcccgcccgaggucgagcgggccgugcuggacgacggcaucuaccgcaucaugcagcggggccuccuggggcgcagccaggugggcgucgggguguuccaggagaacguguuccacaccauguggcacgucacgcggggcgccgugcugauguaccaggggaagcgccucgagcccuccugggcgagcgugaagaaggaccugaucuccuacggcggcggguggcggcugcagggcagcuggaacaccggggaggagguccaggugaucgccguggagcccggcaagaaccccaagaacguccagaccgcccccgggaccuucaagacgcccgagggcgaggugggcgccaucgcccucgacuucaagcccgggaccuccggcagccccaucgugaaccgcgaggggaagaucgucggccuguacggcaacgggguggugaccaccuccggcacguacgucagcgcgaucgcccaggccaaggccagccaggaggggccgcugcccgagaucgaggacgagguguuccggaagcgcaaccucaccaucauggaccugcaccccggcuccgggaagacccggcgcuaccugccggcgaucgugcgggaggccaucaagcgcaagcuccgcacccugauccuggcccccacgcgggucguggccagcgagauggccgaggcgcucaagggcaugcccauccgcuaccagaccaccgccgugaaguccgagcacaccggcaaggagaucgucgaccugaugugccacgccacguucaccaugcggcugcucagccccgugcgcgugccgaacuacaacaugaucaucauggacgaggcccacuucaccgaccccuccagcaucgccgcgcggggguacaucuccacccgcgucggcaugggggaggccgccgccaucuucaugacggccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugaagaagaacgggaagcgggugauccagcugagccgcaagacguucgacaccgaguaccagaagaccaagaacaacgacugggacuacgucgugaccacggacaucuccgagaugggcgccaacuuccgggcggaccgcgugaucgacccgcggcgcugccucaagcccgucauccugaaggacgggcccgagcgggugauccuggccggccccaugccggugaccgucgccagcgccgcccagcgccgggggcgcaucggccggaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccgccugcggggcgaggcgcgcaagacguucguggagcugaugcggcgcggggaccuccccgucuggcugagcuacaagguggccuccgagggcuuccaguacagcgaccggcgcuggugcuucgacggcgagcggaacaaccaggugcuggaggagaacauggacgucgagaucuggaccaaggagggggagcgcaagaagcuccggccccgcuggcuggacgcccggaccuacagcgacccccuggcccuccgcgaguucaaggaguucgccgcgggccggcgcuccgugagcggggaccugauccuggagaucggcaagcucccgcagcaccugacccagcgggcccagaacgcccuggacaaccucgugaugcugcacaacuccgagcagggcgggcgcgccuaccggcacgcgauggaggagcugcccgacacgaucgagacccucauccugcuggcccucaucgccguccugaccggcggggugacccuguucuuccucagcggccgcgggcugggcaagaccuccaucggccugcucugcgugauggccagcuccguccugcuguggauggccagcguggagccccacuggaucgcggccuccaucauccucgaguucuuccugauggugcugcucauccccgagccggaccggcagcgcacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccgccaugcuggacguggaccuccaccccgccagcgccuggacgcuguacgcggucgccaccaccaucaucaccccgaugaugcggcacacgaucgagaacaccaccgccaacaucucccugaccgccaucgccaaccaggcggccauccucauggggcuggacaagggcuggcccaucagcaagauggacaucggcgugccccugcucgcccuggggugcuacucccaggugaacccccugacgcucaccgccgcgguccugaugcugguggcccacuacgccaucaucggcccggggcuccaggccaaggccacccgcgaggcgcagaagcgcaccgccgccggcaucaugaagaaccccacgguggacgggaucgucgccaucgaccuggaccccgugguguacgacgccaaguucgagaagcagcugggccagaucaugcuccugauccugugcaccagccagauccuccugaugcggaccaccugggcgcugugcgaguccaucacgcucgccaccggcccccugaccacccugugggaggggagcccgggcaaguucuggaacacgaccaucgccgucuccauggccaacaucuuccgcgggagcuaccucgccggcgcgggccuggccuucucccugaugaagucccucgggggcgggcggcgcggcaccggggcccagggcgagacccugggcgagaaguggaagcggcagcugaaccagcucagcaaguccgaguucaacacguacaagcgcagcgggaucauggagguggaccgguccgaggccaaggagggccugaagcgcggggagaccaccaagcacgcggugagccggggcaccgccaagcugcgcugguucgucgagcggaaccuggugaagcccgaggggaaggugaucgaccucggcugcggccgcgggggcugguccuacuacugcgccgggcugaagaaggucacggaggugaagggcuacaccaagggcgggcccggccacgaggagcccaucccgauggccaccuacggguggaaccuggugaagcuccacagcggcaaggacgucuucuucaucccgcccgagaagugcgacacccugcugugcgacaucggggaguccagccccaacccgacgaucgaggagggccggacccuccgcgugcugaagaugguggagcccuggcugcgggggaaccaguucugcaucaagguccucaaccccuacaugcccuccgugguggagacccuggagcagaugcagcgcaagcacggcggcaugcugguccggaacccgcucagccgcaacuccacccacgagauguacugggugagcugcgggaccggcaacaucguguccgccgucaacaugacgagccggaugcugcugaaccgcuucaccauggcgcaccgcaagcccaccuacgagcgggacguggaccucggggccggcacccgccacguggccgucgagcccgagguggccaaccuggacaucaucggccagcggaucgagaacaucaagcacgagcacaaguccacguggcacuacgacgaggacaaccccuacaagaccugggccuaccacgggagcuacgaggugaagccguccggcagcgcguccagcauggucaacgggguggucaagcugcucaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgccaaguggcuguggggcuuccugagccggaacaagaagccccgcaucugcacccgggaggaguucacgcgcaagguccgguccaacgcggccaucggcgccguguucguggacgagaaccaguggaacagcgccaaggaggcggucgaggacgagcgcuucugggaccucgugcaccgggagcgcgagcugcacaagcaggggaagugcgcgaccugcguguacaacaugaugggcaagcgggagaagaagcugggggaguucggcaaggccaaggggucccgcgccaucugguacauguggcucggcgcccgguuccuggaguucgaggcgcugggcuucaugaacgaggaccacugguucagccgcgagaacucccucagcggggucgagggcgaggggcugcacaagcugggcuacauccuccgggacaucuccaagauccccgggggcaacauguacgccgacgacaccgccggcugggacacccgcaucacggaggacgaccugcagaacgaggcccggaucaccgacaucauggagccggagcacgcccugcucgccaagagcaucuucaagcugaccuaccagaacaagguggugcgcguccagcgccccgccaagaacgggaccgugauggacgugaucucccggcgcgaccagcggggcagcgggcaggucggcacguacggccugaacaccuucaccaacauggaggcccagcucauccgccagauggaguccgaggggaucuucagccccuccgagcuggagacccccaaccuggccgagcgggugcucgacuggcuggagaaguacggcguggagcgccugaagcggauggccaucagcggggacgacugcgucgugaagccgaucgacgaccgcuucgcgacggcccucaccgcccugaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcucgucggccgcgcccgggugucccagggggccggcuggagccugcgcgagaccgcgugccugggcaagagcuacgcccagauguggcagcucauguacuuccaccggcgcgaccugcggcuggccgccaacgcgaucugcuccgccgugcccgucgacuggauccccaccagccgcacgaccugguccauccacgcccaccaccaguggaugaccaccgaggacaugcucagcguguggaaccggguguggaucgaggagaaccccuggauggaggacaagacgcacaucuccagcuggggcgacgucccguaccuggggaagcgcgaggaccaguggugcggcucccugaucggccucaccgcccgcgccaccugggcgaccaacauccagguggccaucaaccaggugcggcgccugaucgggaacgagaacuaccuggacuacaugaccagcaugaagcgguucaagaacgaguccgaccccgagggcgcccucugguga

SEQ ID NO: 8817 - RNA, 9879 nt, Artificial Sequence
  derived and/or modified CDS sequence (opt1) from DENV-1__JQ045633__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcggagcguggcccucgcgccccacgugggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucgccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcgccgccuacggggugcuguucuccggcgugagcuggaccaugaagaucgggaucggcguccugcucaccuggcugggccugaacucccgcagcacgucccucagcaugaccugcaucgccguggggcuggugacccuguaccucggcgucauggugcaggcggacuccgggugcgugaucaacuggaagggccgggagcugaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccgucguggugggggacgucgccggcauccuggcccaggggaagaagaugauccggccccagcccauggaguacaaguacagcuggaaguccuggggcaaggccaagaucaucggcgcggacgugcagaacaccacguucaucaucgacgggcagaacacccccgagugcccggacgaccagcgcgccuggaacaucugggagguggaggacuacggcuucgggaucuucaccaccaacaucuggcugaagcuccgggacagcuacacgcaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggccccaucagccagcacaacuaccgcccgggguacuucacgcagaccgccggccccuggcaccuggggaagcucgagcuggacuucgaccugugcgagggcaccaccgugguggucgacgagcacugcggcaaccgggggcccucccuccgcacgaccaccgugaccggcaagaucauccacgaguggugcugccggagcugcacgcugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggcgguguuccuccugcugaucauggggcagcucaccuggaacgaccugauccgccugugcaucauggugggcgccaacgccagcgaccgcauggggaugggcacgaccuaccucgcccugauggccaccuucaagaugcggcccauguucgcggucggccuccuguuccgccggcugaccucccgcgaggugcugcuccugacgaucgggcugagccucguggccuccgucgagcugccgaacagccuggaggagcucggcgacgggcuggccaugggcaucaugauccugaagcuccugaccgacuuccagucccaccagcugugggccacccuccugagccugaccuucaucaagacgaccuucucccuccacuacgcguggaagaccauggccauggugcugagcaucgucucccuguucccccucugccugagcaccacgucccagaagaccaccuggcugcccgugcuccugggcagccuggggugcaagccccucaccauguuccugaucgccgagaacaagaucuggggccggcgcuccuggccgcugaacgaggggaucauggccgugggcaucgucagcauccuccugagcucccugcucaagaacgacgugccccuggccgggccccugaucgcgggcggcaugcucaucgccugcuacgugaucagcggguccagcgccgaccugucccuggagaaggccgccgaggucagcugggaggaggaggcggagcacuccggcgccagccacaacauccucguggaggugcaggacgacgggacgaugaagaucaaggacgaggagcgggacgacacccugaccauccugcucaaggccacccugcuggccgucuccggcguguacccccucagcaucccggccacccuguucgugugguacuucuggcagaagaagaagcagcgcuccgggguccugugggacacgcccuccccgcccgagguggagcgggcggugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagccgagcugggccuccgucaagaaggaccugaucagcuacggcggcggguggcggcugcagggcuccuggaacaccggggaggagguccaggugaucgccgucgagcccggcaagaaccccaagaacgugcagacggcccccgggaccuucaagaccccggagggcgaggugggcgcgaucgcccucgacuucaagcccgggaccagcggcucccccaucgucaaccgcgaggggaagaucgugggccuguacggcaacgggguggucacgaccagcggcaccuacgugagcgccaucgcccaggcgaaggugucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccgcacccugauccuggccccgacccggguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccggcugcgcggcgaggcccggaagaccuucguggagcugaugcgccgcggggaccucccgguguggcuguccuacaaggucgccagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccuguucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgcgaggcccagaagcggaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccggggguccuaccucgcgggcgccggccuggccuucagccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaaguacgccgugucccgcggcaccgccaagcugcggugguucguggagcgcaaccuggucaagccggaggggaaggugaucgaccucggcugcggccgcggcggguggagcuacuacugcgccgggcugaagaaggugaccgaggucaagggguacaccaagggcggccccggccacgaggagcccauccccauggccacguacggguggaaccuggugaagcuccacuccggcaaggacguguucuucgucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgcuucaccauggcccaccggaagccgacguacgagcgcgacgucgaccucggggccggcacccggcacguggccguggagcccgaggucgccaaccuggacaucaucggccagcgcaucgagaacaucaagcacgagcacaagagcaccuggcacuacgacgaggacaaccccuacaagaccugggcguaccacggguccuacgaggugaagcccagcggcuccgccagcagcauggucaacgggguggugaagcugcucacgaagccgugggacgucauccccauggugacccagaucgccaugaccgacaccacgcccuucggccagcagcggguguucaaggagaaggucgacacccgcacccccaaggccaagcgggggaccgcccagaucauggaggugacggcgaaguggcuguggggcuuccugucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggcccgcaucaccgacaucauggagcccgagcacgcgcugcucgccaaguccaucuucaagcugacguaccagaacaaggucgugcgcgugcagcggccggccaagaacgggaccgucauggacgugaucagccgccgggaccagcgcggcuccggccagguggggaccuacggccugaacaccuucacgaacauggaggcccagcucauccggcagauggagagcgaggggaucuucucccccagcgagcuggagacccccaaccuggccgagcgcguccucgacuggcuggagaaguacggcguggagcggcugaagcgcauggcgaucuccggggacgacugcguggucaagcccaucgacgaccgguucgccaccgcccucaccgcccugaacgacaugggcaaggugcgcaaggacaucccgcagugggagcccagcaagggguggaacgacuggcagcagguccccuucugcucccaccacuuccaccagcugaucaugaaggacggccgggagaucgucgugcccugccgcaaccaggacgagcucgugggccgggcccgcgucagccagggggcgggcuggagccugcgggagacggccugccuggggaaguccuacgcccagauguggcagcucauguacuuccaccgccgggaccugcgccuggccgcgaacgccaucugcagcgccgugccgguggacuggauccccaccucccggaccaccuggagcauccacgcccaccaccaguggaugacgaccgaggacaugcucuccgucuggaaccgcguguggaucgaggagaaccccuggauggaggacaagacccacaucagcuccuggggcgacgugcccuaccuggggaagcgcgaggaccaguggugcggcagccugaucggccucaccgcccgggcgacgugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8818 - RNA, 9879 nt, Artificial Sequence
  derived and/or modified CDS sequence (opt1) from DENV-1__JQ045634__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcggagcguggcccucgcgccccacgugggccuggggcuggagacccgcaccgagaccuggaugagcuccgagggcgccuggaagcagauccagcggguggagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucgccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcgccgccuacggggugcuguucuccggcgugagcuggaccaugaagaucgggaucggcguccugcucaccuggcugggccugaacucccgcagcacgucccucagcaugaccugcaucgccguggggcuggugacccuguaccucggcgucauggugcaggcggacuccgggugcgugaucaacuggaagggccgggagcugaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccgucguggugggggacgucgccggcauccuggcccaggggaagaagaugauccggccccagcccauggaguacaaguacagcuggaaguccuggggcaaggccaagaucaucggcgcggacgugcagaacaccacguucaucaucgacgggcagaacacccccgagugcccggacgaccagcgcgccuggaacaucugggagguggaggacuacggcuucgggaucuucaccaccaacaucuggcugaagcuccgggacagcuacacgcaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccucuggagcaacggcguccuggaguccgagaugaucauccccaagaucuacgggggccccaucagccagcacaacuaccgcccgggguacuucacgcagaccgccggccccuggcaccuggggaagcucgagcuggacuucgaccugugcgagggcaccaccgugguggucgacgagcacugcggcaaccgggggcccucccuccgcacgaccaccgugaccggcaagaucauccacgaguggugcugccggagcugcacgcugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggcgguguuccuccugcugaucauggggcagcucaccuggaacgaccugauccgccugugcaucauggugggcgccaacgccagcgaccgcauggggaugggcacgaccuaccucgcccugauggccaccuucaagaugcggcccauguucgcggucggccuccuguuccgccggcugaccucccgcgaggugcugcuccugacgaucgggcugagccucguggccuccgucgagcugccgaacagccuggaggagcucggcgacgggcuggccaugggcaucaugauccugaagcuccugaccgacuuccagucccaccagcugugggccacccuccugagccugaccuucaucaagacgaccuucucccuccacuacgcguggaagaccauggccauggugcugagcaucgucucccuguucccccucugccugagcaccacgucccagaagaccaccuggcugcccgugcuccugggcagccuggggugcaagccccucaccauguuccugaucgccgagaacaagaucuggggccggcgcuccuggccgcugaacgaggggaucauggccgugggcaucgucagcauccuccugagcucccugcucaagaacgacgugccccuggccgggccccugaucgcgggcggcaugcucaucgccugcuacgugaucagcggguccagcgccgaccugucccuggagaaggccgccgaggucagcugggaggaggaggcggagcacuccggcgccagccacaacauccucguggaggugcaggacgacgggacgaugaagaucaaggacgaggagcgggacgacacccugaccauccugcucaaggccacccugcuggccgucuccggcguguacccccucagcaucccggccacccuguucgugugguacuucuggcagaagaagaagcagcgcuccgggguccugugggacacgcccuccccgcccgagguggagcgggcggugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagccgagcugggccuccgucaagaaggaccugaucagcuacggcggcggguggcggcugcagggcuccuggaacaccggggaggagguccaggugaucgccgucgagcccggcaagaaccccaagaacgugcagacggcccccgggaccuucaagaccccggagggcgaggugggcgcgaucgcccucgacuucaagcccgggaccagcggcucccccaucgucaaccgcgaggggaagaucgugggccuguacggcaacgggguggucacgaccagcggcaccuacgugagcgccaucgcccaggcgaaggugucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccgcacccugauccuggccccgacccggguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccggcugcgcggcgaggcccggaagaccuucguggagcugaugcgccgcggggaccucccgguguggcuguccuacaaggucgccagcgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccuguucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgcgaggcccagaagcggaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccggggguccuaccucgcgggcgccggccuggccuucagccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaaguacgccgugucccgcggcaccgccaagcugcggugguucguggagcgcaaccuggucaagccggaggggaaggugaucgaccucggcugcggccgcggcgggugggccuacuacugcgccgggcugaagaaggugaccgaggucaagggguacaccaagggcgggcccggccacgaggagcccauccccauggcgacguacggguggaaccuggugaagcuccacagcggcaaggacguguucuucgucccgcccgagaagugcgacacccugcugugcgacaucggggaguccagccccaaccccaccaucgaggagggccgcacccuccgggugcugaagaugguggagccguggcugcgcgggaaccaguucugcaucaagauccucaaccccuacaugcccuccgucguggagacgcuggagcagaugcagcggaagcacggcggcaugcuggugcgcaacccccucagccggaacuccacccacgagauguacugggucagcugcgggaccggcaacaucguguccgccgugaacaugaccagccgcaugcugcugaaccgcuucaccauggcccaccggaagccgacguacgagcgcgacgucgaccucggggccggcacccggcacguggccguggagcccgaggucgcgaaccuggacaucaucggccagcgcaucgagaacaucaagcacgagcacaaguccaccuggcacuacgacgaggacaaccccuacaagaccugggccuaccacgggagcuacgaggugaagcccuccggcagcgccuccagcauggucaacgggguggugaagcugcucacgaagccgugggacgucauccccauggugacccagaucgccaugaccgacaccacgcccuucggccagcagcggguguucaaggagaaggucgacacccgcacccccaaggccaagcgggggaccgcgcagaucauggaggugacggccaaguggcuguggggcuuccugagccgcaacaagaagccgcggaucugcacccgcgaggaguucacccggaaggugcgcuccaacgccgccaucggcgcggucuucguggacgagaaccaguggaacagcgccaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacacggccggcugggacacccggaucaccgaggacgaccugcagaacgaggcgcgcaucaccgacaucauggagcccgagcacgcccugcucgccaagagcaucuucaagcugacguaccagaacaaggucgugcgcgugcagcggccggccaagaacgggaccgucauggacgugaucucccgccgggaccagcgcggcagcggccagguggggaccuacggccugaacaccuucacgaacauggaggcccagcucauccggcagauggaguccgaggggaucuucagccccuccgagcuggagacccccaaccuggcggagcgcguccucgacuggcuggagaaguacggcguggagcggcugaagcgcauggccaucagcggggacgacugcguggucaagcccaucgacgaccgguucgccaccgcccucaccgcccugaacgacaugggcaaggugcgcaaggacaucccgcagugggagcccuccaagggguggaacgacuggcagcagguccccuucugcagccaccacuuccaccagcugaucaugaaggacggccgggagaucgucgugcccugccgcaaccaggacgagcucgugggccgggcgcgcgucucccagggggccggcuggagccugcgggagacggccugccugggcaagagcuacgcccagauguggcagcucauguacuuccaccgccgggaccugcgccuggcggccaacgccaucugcuccgccgugccgguggacuggauccccaccagccggaccaccugguccauccacgcccaccaccaguggaugacgaccgaggacaugcucagcgucuggaaccgcguguggaucgaggagaaccccuggauggaggacaagacccacaucuccagcuggggcgacgugcccuaccuggggaagcgcgaggaccaguggugcggcucccugaucggccucaccgcgcgggccacgugggccaccaacauccaggucgccaucaaccaggugcgccggcugaucgggaacgagaacuaccuggacuacaugaccagcaugaagcgcuucaagaacgaguccgacccggagggcgcccucugguga

SEQ ID NO: 8819 - RNA, 9879 nt, Artificial Sequence
  derived and/or modified CDS sequence (opt1) from DENV-1__JQ045636__SS-prME
agcgugaccaugcugcucaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaucgcgaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggccacccagaacggccggcugaucaccgccaacccgaucgugacggacaaggagaagcccgugaacaucgaggcggagccgcccuucggggagagcuacaucgucaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcguguucaccuccguggggaagcugguccaccagaucuucggcacggccuacggggugcuguucagcggcguguccuggaccaugaagaucgggaucggcguccuccugaccuggcugggccucaacagccgcuccaccagccuguccaugacgugcaucgccguggggcuggugacccucuaccugggcgucauggugcaggcggacagcgggugcgugaucaacuggaagggccgggagcugaagugcgggagcggcaucuucgucaccaacgaggugcacaccuggacggagcaguacaaguuccaggccgacuccccgaagcgccucagcgccgccaucggcaaggccugggaggagggggugugcggcauccgguccgcgacccgccuggagaacaucauguggaagcagaucagcaacgagcugaaccacauccuccuggagaacgacaugaagcugaccgucguggugggggacgucgccggcauccucgcccaggggaagaagaugauccggccccagcccauggaguacaaguacuccuggaaguccuggggcaaggccaagaucaucggcgcggacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacuccuacacccaggucugcgaccaccgccucaugagcgccgccaucaaggacuccaaggccgugcacgcggacaugggcuacuggaucgagagcgagaagaacgagacguggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgugguggucgacgagcacugcggcaaccgggggccgagccugcgcaccacgaccgugaccggcaagaucauccacgaguggugcugccgguccugcacccugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugacgggcacccuggcgguguucuuccugcucaucauggggcagcugaccuggaacgaccugauccggcucugcaucauggugggcgccgacgccuccgaccgcauggggaugggcaccacguaccuggcccugauggccaccuucaagaugcgcccgauguucgcggucgggcuccuguuccggcgccugaccagccgggaggugcuccugcugaccaucgggcucucccugguggccagcgucgagcugcccaacucccucgaggagcugggcgacgggcuggccaugggcaucaugauccucaagcugcugacggacuuccagagccaccagcucugggccacccugcugucccucaccuucauccgcaccacguucagccugcacuacgcguggaagaccauggccauggugcuguccaucgucagccucuucccccugugccuguccaccaccagccagaagacgaccuggcuccccgugcugcugggcucccucgggugcaagccgcugaccauguuccugaucgccgagaacaagaucuggggccgcaagagcuggccccucaacgaggggaucauggccgugggcaucgucagcauccugcuguccagccuccugaagaacgacgugccccuggccgggccccucaucgcgggcggcaugcugaucgccugcuacgugaucuccgggagcuccgccgaccugagccucgagaaggccgccgucguguccugggaggaggaggcggagcacagcggcgccucccacaacauccugguggagguccaggacgacgggaccaugaagaucaaggacgaggagcgcgacgacacgcugaccauccuccugaaggccacccugcucgccgugagcggcguguacccgcuguccauccccgccacccuguucgucugguacuucuggcagaagaagaagcagcggagcggggugcucugggacacccccagcccgcccgagguggagcgcgcgguccuggacgacggcaucuaccggaucaugcagcgcggccugcuggggcggagccaggugggcgugggggucuuccaggagaacguguuccacacgauguggcacgugacccgcggcgccguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagaccgcccccgggacguucaagaccuccgagggcgaggucggcgcgaucgcccuggacuucaagcccgggaccagcggcagccccaucgugaaccgggaggggaagaucgugggccuguacggcaacggggucgugaccacguccggcaccuacgugagcgccaucgcccaggcgaaggccucccaggaggggccccucccggagaucgaggacgaggucuuccgcaagcggaaccugaccaucauggaccugcaccccggcagcgggaagacccgccgguaccuccccgccaucgugcgcgaggccaucaagcggaagcugcgcacgcugauccucgccccgacccgcguggucgcguccgagauggccgaggcccugaagggcaugcccauccgguaccagaccaccgccgucaagagcgagcacacgggcaaggagaucguggaccugaugugccacgccaccuucaccaugcgccuccugucccccguccgggugcccaacuacaacaugaucaucauggacgaggcgcacuucaccgacccgagcuccaucgccgcccgcggguacaucagcacgcgggugggcaugggggaggccgccgcgaucuucaugaccgccacgccgcccggcuccgucgaggccuucccccagagcaacgccgugauccaggacgaggagcgcgacaucccggagcgguccuggaacagcggguacgaguggaucaccgacuuccccggcaagacggugugguucguccccuccaucaagagcggcaacgacaucgcgaacugccugcgcaagaacgggaagcgggugauccagcucucccgcaagaccuucgacaccgaguaccagaagaccaagaacaacgacugggacuacguggucacgaccgacaucagcgagaugggcgccaacuuccgggccgaccgcgugaucgacccccggcgcugccugaagccggugauccugaaggacgggcccgagcgggucauccucgccggccccaugcccgugaccgucgccuccgcggcccagcgccgggggcgcaucggccggaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgaccccgagcgcgagaaguccgcggccaucgacggggaguaccgccugcggggcgaggcccgcaagaccuucguggagcucaugcggcgcggggaccugccgguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcgcugcgcgaguucaaggaguucgccgccggccggcgcagcgucuccggggaccugauccucgagaucggcaagcugccccagcaccugacgcagcgggcccagaacgcgcucgacaaccuggugaugcugcacaacagcgagcagggcgggcgcgccuaccggcacgccauggaggagcucccggacaccaucgagacccugaugcugcucgcccugaucgccgugcugaccggcggggucacccuguucuuccuguccggccgcgggcugggcaagaccagcaucggccuccugugcgugauggcguccagcgugcugcucuggauggccuccgucgagccccacuggaucgccgccagcaucauccuggaguucuuccugauggugcuccugauccccgagcccgaccggcagcgcaccccgcaggacaaccagcuggccuacguggucaucgggcuccuguucaugauccugaccguggcggccaacgagaugggccuccuggagaccacgaagaaggaccuggggaucggccacguggccgucgagaaccaccaccacgccgccaugcucgacguggaccugcaccccgcguccgccuggacccuguacgccguggccaccaccaucaucacgcccaugaugcggcacaccaucgagaacaccaccgccaacaucagccucacggcgaucgccaaccaggccgccauccugauggggcuggacaagggcuggccgaucuccaagauggacaucggcgucccccuccuggcgcuggggugcuacagccaggugaacccccucacccugaccgccgccgugcugaugcucgucgcccacuacgccaucaucggccccgggcugcaggcgaaggccacccgcgaggcccagaagcgcacggccgccggcaucaugaagaacccgaccguggacgggaucguggcgaucgaccuggaccccgucguguacgacgccaaguucgagaagcagcucggccagaucaugcugcugauccucugcaccucccagauccugcugaugcggaccacgugggcccucugcgagagcaucacccuggccaccggcccccugaccacgcucugggaggggucccccggcaaguucuggaacaccaccaucgccgugagcauggcgaacaucuuccgcgggagcuaccuggccggcgccggccuggccuucucccucaugaagucccucgggggcgggcggcgcgggaccggggcgcagggcgagacgcugggcgagaaguggaagcggcagcucaaccagcuguccaagagcgaguucaacaccuacaagcgcuccgggaucauggaggucgaccggagcgaggccaaggagggccugaagcgcggggagaccaccaagcacgccgugucccggggcacggccaagcuccgcugguucguggagcggaaccuggucaagccggaggggaaggugaucgaccugggcugcggccgcgggggcuggagcuacuacugcgccgggcugaagaaggugaccgaggucaagggcuacaccaagggcgggcccggccacgaggagcccauccccauggcgaccuacggguggaaccucgugaagcugcacuccggcaaggacguguucuucaucccgcccgagaagugcgacacgcugcucugcgacaucggggagagcucccccaaccccaccaucgaggagggccggacccugcgcguccugaagaugguggagccguggcuccgggggaaccaguucugcaucaagauccugaaccccuacaugcccagcguggucgagacccuggagcagaugcagcgcaagcacggcggcaugcucgugcggaacccccugucccgcaacagcacgcacgagauguacuggguguccugcgggaccggcaacaucgucagcgccgugaacaugaccucccggaugcugcucaaccgcuucaccauggcccaccgcaagccgaccuacgagcgggacguggaccugggggccggcacgcgccacgucgccguggagcccgagguggcgaaccuggacaucaucggccagcggaucgagaacaucaagcacgagcacaagagcaccuggcacuacgacgaggacaaccccuacaagaccugggccuaccacggguccuacgaggucaagcccagcggcagcgccuccagcauggugaacggggucgugaagcuccugaccaagccgugggacgugauccccauggucacgcagaucgccaugaccgacaccacccccuucggccagcagcgcguguucaaggagaagguggacacgcggacccccaaggccaagcgcgggaccgcgcagaucauggaggucaccgccaaguggcuguggggcuuccucucccggaacaagaagccgcgcaucugcacgcgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacgcgcaucaccgaggacgaccugcagaacgaggcgaagaucaccgacaucauggagcccgagcacgcccuccuggccaaguccaucuucaagcugaccuaccagaacaaggugguccgggugcagcgcccggccaagaacgggacggugauggacgucaucagccgccgggaccagcgcggcuccggccaggugggcaccuacggccucaacaccuucaccaacauggaggcccagcugauccggcagauggagagcgaggggaucuucucccccagcgagcuggagacgcccaaccucgcgggccgcgugcuggacuggcuggagaagcacggggucgagcggcucaagcgcauggccaucuccggcgacgacugcguggugaagcccaucgacgaccgguucgccaccgcccugaccgcccugaacgacauggggaagguccgcaaggacaucccgcagugggagcccagcaagggcuggaacgacuggcagcagguccccuucugcagccaccacuuccaccagcucaucaugaaggacggccgggagaucgugguccccugccgcaaccaggacgagcugguggggcgggcgcgcgugucccagggcgccggguggagccugcgggagaccgccugccucggcaaguccuacgcccagauguggcagcugauguacuuccaccgccgggaccugcgccucgcggccaacgccaucugcagcgccgucccgguggacugggugcccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugcccuaccugggcaagcgggaggaccaguggugcggcagccucaucgggcugaccgcgcgcgccaccugggccacgaacauccaggucgccaucaaccaggugcgccggcugcucggcaacgagaacuaccuggacuacaugaccuccaugaagcgcuucaagaacgagagcgacccggagggggcccugugguga

SEQ ID NO: 8820 - RNA, 9879 nt, Artificial Sequence
  derived and/or modified CDS sequence (opt1) from DENV-1__JQ045635__SS-prME
agcgugaccaugcugcucaugcugaugcccaccgcccuggccuuccaccucacgacccgcggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccucgggcuggagacgcgcaccgagaccuggaugagcuccgagggcgccuggaagcagauccagcgggucgagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaucgcgaccaucacgccccaggcccccagcaccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccuccaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcucguccagaucaaguacgagggcacggacgcccccugcaagauccccuucuccacccaggacgagaagggggccacccagaacggccggcugaucaccgccaacccgaucgugacggacaaggagaagcccgugaacaucgaggcggagccgcccuucggggagagcuacaucgucaucggcgccggcgagaaggcccugaagcuguccugguucaagaaggggagcuccaucggcaagauguucgaggccaccgcccgcggggcgcggcgcauggccauccucggcgacaccgccugggacuucgggagcaucggcggcguguucaccuccguggggaagcugguccaccagaucuucggcacggccuacggggugcuguucagcggcguguccuggaccaugaagaucgggaucggcguccuccugaccuggcugggccucaacagccgcuccaccagccuguccaugacgugcaucgccguggggcuggugacccucuaccugggcgucauggugcaggcggacagcgggugcgugaucaacuggaagggccgggagcugaagugcgggagcggcaucuucgucaccaacgaggugcacaccuggacggagcaguacaaguuccaggccgacuccccgaagcgccucagcgccgccaucggcaaggccugggaggagggggugugcggcauccgguccgcgacccgccuggagaacaucauguggaagcagaucagcaacgagcugaaccacauccuccuggagaacgacaugaagcugaccgucguggugggggacgucgccggcauccucgcccaggggaagaagaugauccggccccagcccauggaguacaaguacuccuggaaguccuggggcaaggccaagaucaucggcgcggacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacuccuacacccaggucugcgaccaccgccucaugagcgccgccaucaaggacuccaaggccgugcacgcggacaugggcuacuggaucgagagcgagaagaacgagacguggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgugguggucgacgagcacugcggcaaccgggggccgagccugcgcaccacgaccgugaccggcaagaucauccacgaguggugcugccgguccugcacccugccgccccuccgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugacgggcacccuggcgguguucuuccugcucaucauggggcagcugaccuggaacgaccugauccggcucugcaucauggugggcgccgacgccuccgaccgcauggggaugggcaccacguaccuggcccugauggccaccuucaagaugcgcccgauguucgcggucgggcuccuguuccggcgccugaccagccgggaggugcuccugcugaccaucgggcucucccugguggccagcgucgagcugcccaacucccucgaggagcugggcgacgggcuggccaugggcaucaugauccucaagcugcugacggacuuccagagccaccagcucugggccacccugcugucccucaccuucauccgcaccacguucagccugcacuacgcguggaagaccauggccauggugcuguccaucgucagccucuucccccugugccuguccaccaccagccagaagacgaccuggcuccccgugcugcugggcucccucgggugcaagccgcugaccauguuccugaucgccgagaacaagaucuggggccgcaagagcuggccccucaacgaggggaucauggccgugggcaucgucagcauccugcuguccagccuccugaagaacgacgugccccuggccgggccccucaucgcgggcggcaugcugaucgccugcuacgugaucuccgggagcuccgccgaccugagccucgagaaggccgccgucguguccugggaggaggaggcggagcacagcggcgccucccacaacauccugguggagguccaggacgacgggaccaugaagaucaaggacgaggagcgcgacgacacgcugaccauccuccugaaggccacccugcucgccgugagcggcguguacccgcuguccauccccgccacccuguucgucugguacuucuggcagaagaagaagcagcggagcggggugcucugggacacccccagcccgcccgagguggagcgcgcgguccuggacgacggcaucuaccggaucaugcagcgcggccugcuggggcggagccaggugggcgugggggucuuccaggagaacguguuccacacgauguggcacgugacccgcggcgccguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagaccgcccccgggacguucaagaccuccgagggcgaggucggcgcgaucgcccuggacuucaagcccgggaccagcggcagccccaucgugaaccgggaggggaagaucgugggccuguacggcaacggggucgugaccacguccggcaccuacgugagcgccaucgcccaggcgaaggccucccaggaggggccccucccggagaucgaggacgaggucuuccgcaagcggaaccugaccaucauggaccugcaccccggcagcgggaagacccgccgguaccuccccgccaucgugcgcgaggccaucaagcggaagcugcgcacgcugauccucgccccgacccgcguggucgcguccgagauggccgaggcccugaagggcaugcccauccgguaccagaccaccgccgucaagagcgagcacacgggcaaggagaucguggaccugaugugccacgccaccuucaccaugcgccuccugucccccguccgggugcccaacuacaacaugaucaucauggacgaggcgcacuucaccgacccgagcuccaucgccgcccgcggguacaucagcacgcgggugggcaugggggaggccgccgcgaucuucaugaccgccacgccgcccggcuccgucgaggccuucccccagagcaacgccgugauccaggacgaggagcgcgacaucccggagcgguccuggaacagcggguacgaguggaucaccgacuuccccggcaagacggugugguucguccccuccaucaagagcggcaacgacaucgcgaacugccugcgcaagaacgggaagcgggugauccagcucucccgcaagaccuucgacaccgaguaccagaagaccaagaacaacgacugggacuacguggucacgaccgacaucagcgagaugggcgccaacuuccgggccgaccgcgugaucgacccccggcgcugccugaagccggugauccugaaggacgggcccgagcgggucauccucgccggccccaugcccgugaccgucgccuccgcggcccagcgccgggggcgcaucggccggaaccacaacaaggagggcgaccaguacaucuacauggggcagccgcugaacaacgacgaggaccacgcccacuggaccgaggccaagaugcugcucgacaacaucaacacgcccgagggcaucauccccgcccuguucgaccccgagcgcgagaaguccgcggccaucgacggggaguaccgccugcggggcgaggcccgcaagaccuucguggagcucaugcggcgcggggaccugccgguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcgcugcgcgaguucaaggaguucgccgccggccggcgcagcgucuccggggaccugauccucgagaucggcaagcugccccagcaccugacgcagcgggcccagaacgcgcucgacaaccuggugaugcugcacaacagcgagcagggcgggcgcgccuaccggcacgccauggaggagcucccggacaccaucgagacccugaugcugcucgcccugaucgccgugcugaccggcggggucacccuguucuuccuguccggccgcgggcugggcaagaccagcaucggccuccugugcgugauggcguccagcgugcugcucuggauggccuccgucgagccccacuggaucgccgccagcaucauccuggaguucuuccugauggugcuccugauccccgagcccgaccggcagcgcaccccgcaggacaaccagcuggccuacguggucaucgggcuccuguucaugauccugaccguggcggccaacgagaugggccuccuggagaccacgaagaaggaccuggggaucggccacguggccgucgagaaccaccaccacgccgccaugcucgacguggaccugcaccccgcguccgccuggacccuguacgccguggccaccaccaucaucacgcccaugaugcggcacaccaucgagaacaccaccgccaacaucagccucacggcgaucgccaaccaggccgccauccugauggggcuggacaagggcuggccgaucuccaagauggacaucggcgucccccuccuggcgcuggggugcuacagccaggugaacccccucacccugaccgccgccgugcugaugcucgucgcccacuacgccaucaucggccccgggcugcaggcgaaggccacccgcgaggcccagaagcgcacggccgccggcaucaugaagaacccgaccguggacgggaucguggcgaucgaccuggaccccgucguguacgacgccaaguucgagaagcagcucggccagaucaugcugcugauccucugcaccucccagauccugcugaugcggaccacgugggcccucugcgagagcaucacccuggccaccggcccccugaccacgcucugggaggggucccccggcaaguucuggaacaccaccaucgccgugagcauggcgaacaucuuccgcgggagcuaccuggccggcgccggccuggccuucucccucaugaagucccucgggggcgggcggcgcgggaccggggcgcagggcgagacgcugggcgagaaguggaagcggcagcucaaccagcuguccaagagcgaguucaacaccuacaagcgcuccgggaucauggaggucgaccggagcgaggccaaggagggccugaagcgcggggagaccaccaagcacgccgugucccggggcacggccaagcuccgcugguucguggagcggaaccuggucaagccggaggggaaggugaucgaccugggcugcggccgcgggggcugggccuacuacugcgcggggcugaagaaggugaccgaggucaagggcuacaccaagggcgggcccggccacgaggagcccauccccauggccaccuacggguggaaccucgugaagcugcacagcggcaaggacguguucuucaucccgcccgagaagugcgacacgcugcucugcgacaucggggaguccagccccaaccccaccaucgaggagggccggacccugcgcguccugaagaugguggagccguggcuccgggggaaccaguucugcaucaagauccugaaccccuacaugcccuccguggucgagacccuggagcagaugcagcgcaagcacggcggcaugcucgugcggaacccccugagccgcaacuccacgcacgagauguacugggugagcugcgggaccggcaacaucgucuccgccgugaacaugaccagccggaugcugcucaaccgcuucaccauggcccaccgcaagccgaccuacgagcgggacguggaccugggggccggcacgcgccacgucgcgguggagcccgagguggccaaccuggacaucaucggccagcggaucgagaacaucaagcacgagcacaaguccaccuggcacuacgacgaggacaaccccuacaagaccugggccuaccacgggagcuacgaggucaagcccuccggcagcgccagcuccauggugaacggggucgugaagcuccugaccaagccgugggacgugauccccauggucacgcagaucgccaugaccgacaccacccccuucggccagcagcgcguguucaaggagaagguggacacgcggacccccaaggcgaagcgcgggaccgcccagaucauggaggucaccgccaaguggcuguggggcuuccucagccggaacaagaagccgcgcaucugcacgcgggaggaguucacccgcaaggugcgguccaacgccgcgaucggcgccguguucgucgacgagaaccaguggaacagcgccaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggcgaaggggucccgcgccaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacaccgcgggcugggacacgcgcaucaccgaggacgaccugcagaacgaggccaagaucaccgacaucauggagcccgagcacgcccuccuggccaagagcaucuucaagcugaccuaccagaacaaggugguccgggugcagcgcccggccaagaacgggacggugauggacgucaucucccgccgggaccagcgcggcagcggccaggugggcaccuacggccucaacaccuucaccaacauggaggcgcagcugauccggcagauggaguccgaggggaucuucagccccuccgagcuggagacgcccaaccucgccggccgcgugcuggacuggcuggagaagcacggggucgagcggcucaagcgcauggccaucagcggcgacgacugcguggugaagcccaucgacgaccgguucgccaccgcccugaccgcgcugaacgacauggggaagguccgcaaggacaucccgcagugggagcccuccaagggcuggaacgacuggcagcagguccccuucugcagccaccacuuccaccagcucaucaugaaggacggccgggagaucgugguccccugccgcaaccaggacgagcugguggggcgggcccgcgugagccagggcgccggguggucccugcgggagaccgccugccucggcaagagcuacgcgcagauguggcagcugauguacuuccaccgccgggaccugcgccucgccgccaacgccaucugcuccgccgucccgguggacugggugcccacgagccggaccaccugguccauccacgcgcaccaccaguggaugaccacggaggacaugcugagcgucuggaaccgcguguggaucgaggagaaccccuggauggaggacaagacccacaucuccagcuggggcgacgugcccuaccugggcaagcgggaggaccaguggugcggcucccucaucgggcugaccgcccgcgccaccugggccacgaacauccaggucgccaucaaccaggugcgccggcugcucggcaacgagaacuaccuggacuacaugaccagcaugaagcgcuucaagaacgaguccgacccggagggggcgcugugguga

SEQ ID NO: 8821 - RNA, 9879 nt, Artificial Sequence
  derived and/or modified CDS sequence (opt1) from DENV-1__JQ045637__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagauguccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggccggcauccucgcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcucccgggggccgagccugcgcaccaccaccgugacgggcaagaucauccacgaguggugcugccgguccugcacccugccgccccuccgcuuccgcggggaggacggcugcugguacgggauggagauccgccccgucaaggagaaggaggagaaccuggugaaguccauggugagcgccggcuccggcgaggucgacagccucucccuggggcugcucugcaucagcaucaugaucgaggaggugaugcggucccgcuggagccggaagaugcugaugaccggcacccuggccguguucuuccuccugaucauggggcagcugacguggaacgaccucauccgccugugcaucauggucggcgccaacgcguccgaccgcauggggaugggcaccaccuaccuggcccucauggccgccuucaagaugcggccgauguucgccgugggccugcuguuccgccggcucaccagccgcgaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucaucaagacgaccuucagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccggcgcagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgcgaggggaagaucgugggccucuacggcaacggggucgugacgaccagcggcaccuacguguccgccaucgcccaggccaaggcgagccaggaggggccgcugcccgagaucgaggacgaggucuuccggaagcgcaaccugaccaucauggaccuccaccccggcuccgggaagacgcggcgcuaccugccggccaucgugcgggaggccaucaagcgcaagcugcgcacccucauccuggcccccacccggguggucgccagcgagauggcggaggcccugaagggcaugcccauccgcuaccagaccacggccgugaaguccgagcacaccggcaaggagaucguggaccucaugugccacgccaccuucaccaugcggcugcugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccuccggaagaacgggaagcgcgugauccagcugagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccucaaggacgggcccgagcgcgucauccuggccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccguguggcucagcuacaaggucgccagcgagggcuuccaguacuccgaccgccgguggugcuucgacggcgagcgcaacaaccaggugcuggaggagaacauggacguggagaucuggaccaaggagggggagcggaagaagcugcgcccccgguggcucgacgcccgcacguacagcgacccccuggcccugcgggaguucaaggaguucgcggccggccgccgguccgucagcggggaccucauccuggagaucggcaagcugccgcagcaccucacccagcgcgcccagaacgcccuggacaaccuggugaugcuccacaacuccgagcagggcgggcgggcguaccgccacgccaucgaggagcugcccgacaccaucgagacccugaugcuccuggcccugaucgccgugcucacgggcggggucacccuguucuuccugagcggccgggggcucggcaagaccuccaucggccugcugugcgugauggccagcuccgugcuccuguggauggcgagcgucgagccccacuggaucgccgccuccaucauccuggaguucuuccucauggugcugcugauccccgagccggaccgccagcggacgccccaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccagcgcguggacccucuacgccguggccaccacgaucaucaccccgaugaugcgccacaccaucgagaacaccacggccaacaucucccugaccgccaucgcgaaccaggccgccauccugauggggcucgacaagggcuggcccaucagcaagauggacaucggcgucccccugcuggcccucgggugcuacucccaggugaacccccugacccugaccgcggccgugcucaugcuggucgcccacuacgccaucaucggcccggggcugcaggccaaggcgacgcgcgaggcccagaagcggaccgccgccggcaucaugaagaaccccaccguggacgggaucguggccaucgaccucgaccccgucguguacgacgcgaaguucgagaagcagcugggccagaucaugcugcucauccugugcaccagccagauccugcucaugcgcacgaccugggcccugugcgaguccaucacccuggccaccggcccccucacgacccugugggaggggagcccgggcaaguucuggaacaccaccaucgccguguccauggccaacaucuuccgggggagcuaccuggcgggcgccggccucgccuucagccugaugaagucccucgggggcgggcgccgggggacgggggcccagggcgagacccucggcgagaaguggaagcgccagcugaaccagcugagcaaguccgaguucaacaccuacaagcggagcgggaucauggaggucgaccgcuccgaggcgaaggagggccucaagcgcggggagaccacgaagcacgccgugagccgcggcaccgccaagcugcggugguucguggagcgcaaccuggucaagcccgaggggaaggugaucgaccugggcugcggccgcggcgggugguccuacuacugcgccgggcucaagaaggugaccgaggucaagggguacaccaagggcggccccggccacgaggagcccaucccgauggccacguacggguggaaccuggugaagcugcacagcggcaaggacguguucuucaucccgcccgagaagugcgacacccuccugugcgacaucggggaguccagccccaacccgaccaucgaggagggccgcacccugcggguccucaagaugguggagcccuggcugcgcgggaaccaguucugcaucaagauccugaaccccuacaugcccuccguggucgagacgcucgagcagaugcagcggaagcacggcggcaugcuggugcgcaacccgcugagccggaacuccacccacgagauguacugggugagcugcgggaccggcaacaucgucuccgcggugaacaugaccagccgcaugcuccugaaccgcuucaccauggcccaccggaagcccacguacgagcgcgacguggaccugggggccggcacccggcacgucgccguggagcccgagguggccaaccucgacaucaucggccagcgcaucgagaacaucaagcacgagcacaaguccaccuggcacuacgacgaggacaaccccuacaagaccugggcguaccacgggagcuacgaggucaagccguccggcagcgccagcuccauggugaacggggucgugaagcugcugacgaagcccugggacgugauccccauggucacccagaucgccaugaccgacaccacgcccuucggccagcagcggguguucaaggagaagguggacacccgcaccccgaaggccaagcgggggaccgcccagaucauggaggucacggcgaaguggcucuggggcuuccugagccgcaacaagaagccccggaucugcacccgcgaggaguucacccggaaggugcgcuccaacgccgccaucggcgccguguucgucgacgagaaccaguggaacagcgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgccgacgacacggccggcugggacacccggaucaccgaggacgaccuccagaacgaggcccgcaucaccgacaucauggagccggagcacgcgcugcuggcccgcagcaucuucaagcucacguaccagaacaaggugguccgggugcagcgccccgccaagaacgggaccgugauggacgucaucucccggcgcgaccagcggggcagcggccagguggggaccuacggccugaacaccuucacgaacauggaggcccagcugauccgccagauggaguccgaggggaucuucagccccuccgagcucgagacccccaaccuggccgagcgggugcuggacuggcucgagaaguacggcgucgagcgccugaagcggauggcgaucagcggggacgacugcguggugaagccgaucgacgaccgcuucgccaccgcccugaccgcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugagccagggggcgggcuggucccuccgcgagacggccugccugggcaagagcuacgcccagauguggcagcugauguacuuccaccggcgcgaccuccggcuggccgcgaacgccaucugcuccgccguccccguggacuggauccccaccagccgcaccaccugguccauccacgcccaccaccaguggaugacgaccgaggacaugcugagcguguggaaccgcgucuggaucgaggagaaccccuggauggaggacaagacccacaucuccagcuggggcgacgugccguaccucgggaagcgggaggaccaguggugcggcucccugaucggccugaccgcccgcgcgacgugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8822 - RNA, 9879 nt, Artificial Sequence
  derived and/or modified CDS sequence (opt1) from DENV-1__JQ045638__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagauguccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggccggcauccucgcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcucccgggggccgagccugcgcaccaccaccgugacgggcaagaucauccacgaguggugcugccgguccugcacccugccgccccuccgcuuccgcggggaggacggcugcugguacgggauggagauccgccccgucaaggagaaggaggagaaccuggugaaguccauggugagcgccggcuccggcgaggucgacagccucucccuggggcugcucugcaucagcaucaugaucgaggaggugaugcggucccgcuggagccggaagaugcugaugaccggcacccuggccguguucuuccuccugaucauggggcagcugacguggaacgaccucauccgccugugcaucauggucggcgccaacgcguccgaccgcauggggaugggcaccaccuaccuggcccucauggccgccuucaagaugcggccgauguucgccgugggccugcuguuccgccggcucaccagccgcgaggugcugcugcucacgaucgggcugucccuggucgcgagcguggagcuccccaacucccuggaggagcugggcgacgggcucgccaugggcaucaugauccugaagcugcucaccgacuuccagagccaccagcugugggccacccugcucucccugaccuucaucaagacgaccuucagccugcacuacgccuggaagaccauggcgaugguccucuccaucgugagccuguucccccugugccucuccaccacgagccagaagaccaccuggcugcccgugcugcucggcucccuggggugcaagccgcugaccauguuccucaucgccgagaacaagaucuggggccggcgcagcuggccccugaacgaggggaucauggccgucggcaucgugagcauccugcucuccagccugcugaagaacgacgugccccucgccgggccccugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgcuguccauccccgccacccucuucgucugguacuucuggcagaagaagaagcagcgcagcggggugcugugggacacgcccagcccgcccgagguggagcgggccguccuggacgacggcaucuaccgcaucaugcagcggggccugcucgggcgcagccaggugggcgugggggucuuccaggagaacguguuccacaccauguggcacgugacccggggcgcgguccugauguaccaggggaagcgccuggagcccuccugggccagcgugaagaaggaccucaucuccuacggcggcggguggcggcugcagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgcgaggggaagaucgugggccucuacggcaacggggucgugacgaccagcggcaccuacguguccgccaucgcccaggccaaggcgagccaggaggggccgcugcccgagaucgaggacgaggucuuccggaagcgcaaccugaccaucauggaccuccaccccggcuccgggaagacgcggcgcuaccugccggccaucgugcgggaggccaucaagcgcaagcugcgcacccucauccuggcccccacccggguggucgccagcgagauggcggaggcccugaagggcaugcccauccgcuaccagaccacggccgugaaguccgagcacaccggcaaggagaucguggaccucaugugccacgccaccuucaccaugcggcugcugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccuccggaagaacgggaagcgcgugauccagcugagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccucaaggacgggcccgagcgcgucauccuggccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccguguggcucagcuacaaggucgccagcgagggcuuccaguacuccgaccgccgguggugcuucgacggcgagcgcaacaaccaggugcuggaggagaacauggacguggagaucuggaccaaggagggggagcggaagaagcugcgcccccgguggcucgacgcccgcacguacagcgacccccuggcccugcgggaguucaaggaguucgcggccggccgccgguccgucagcggggaccucauccuggagaucggcaagcugccgcagcaccucacccagcgcgcccagaacgcccuggacaaccuggugaugcuccacaacuccgagcagggcgggcgggcguaccgccacgccaucgaggagcugcccgacaccaucgagacccugaugcuccuggcccugaucgccgugcucacgggcggggucacccuguucuuccugagcggccgggggcucggcaagaccuccaucggccugcugugcgugauggccagcuccgugcuccuguggauggcgagcgucgagccccacuggaucgccgccuccaucauccuggaguucuuccucauggugcugcugauccccgagccggaccgccagcggacgccccaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccagcgcguggacccucuacgccguggccaccacgaucaucaccccgaugaugcgccacaccaucgagaacaccacggccaacaucucccugaccgccaucgcgaaccaggccgccauccugauggggcucgacaagggcuggcccaucagcaagauggacaucggcgucccccugcuggcccucgggugcuacucccaggugaacccccugacccugaccgcggccgugcucaugcuggucgcccacuacgccaucaucggcccggggcugcaggccaaggcgacgcgcgaggcccagaagcggaccgccgccggcaucaugaagaaccccaccguggacgggaucguggccaucgaccucgaccccgucguguacgacgcgaaguucgagaagcagcugggccagaucaugcugcucauccugugcaccagccagauccugcucaugcgcacgaccugggcccugugcgaguccaucacccuggccaccggcccccucacgacccugugggaggggagcccgggcaaguucuggaacaccaccaucgccguguccauggccaacaucuuccgggggagcuaccuggcgggcgccggccucgccuucagccugaugaagucccucgggggcgggcgccgggggacgggggcccagggcgagacccucggcgagaaguggaagcgccagcugaaccagcugagcaaguccgaguucaacaccuacaagcggagcgggaucauggaggucgaccgcuccgaggcgaaggagggccucaagcgcggggagaccacgaagcacgccgugagccgcggcaccgccaagcugcggugguucguggagcgcaaccuggucaagcccgaggggaaggugaucgaccugggcugcggccgcgggggcugggccuacuacugcgccgggcucaagaaggugaccgaggucaagggcuacaccaagggcggccccggccacgaggagcccaucccgauggcgacguacggguggaaccuggugaagcugcacuccggcaaggacguguucuucaucccgcccgagaagugcgacacccuccugugcgacaucggggagagcucccccaacccgaccaucgaggagggccgcacccugcggguccucaagaugguggagcccuggcugcgcgggaaccaguucugcaucaagauccugaaccccuacaugcccagcguggucgagacgcucgagcagaugcagcggaagcacggcggcaugcuggugcgcaacccgcugucccggaacagcacccacgagauguacuggguguccugcgggaccggcaacaucgucagcgccgugaacaugaccucccgcaugcuccugaaccgcuucaccauggcccaccggaagcccacguacgagcgcgacguggaccugggggccggcacccggcacgucgccguggagcccgagguggcgaaccucgacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacggggucgugaagcugcugacgaagcccugggacgugauccccauggucacccagaucgccaugaccgacaccacgcccuucggccagcagcggguguucaaggagaagguggacacccgcaccccgaaggccaagcgggggaccgcgcagaucauggaggucacggccaaguggcucuggggcuuccugucccgcaacaagaagccccggaucugcacccgcgaggaguucacccggaaggugcgcagcaacgccgccaucggcgcgguguucgucgacgagaaccaguggaacuccgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggcgcgcaucaccgacaucauggagccggagcacgcccugcuggcccgcuccaucuucaagcucacguaccagaacaaggugguccgggugcagcgccccgccaagaacgggaccgugauggacgucaucagccggcgcgaccagcggggcuccggccagguggggaccuacggccugaacaccuucacgaacauggaggcccagcugauccgccagauggagagcgaggggaucuucucccccagcgagcucgagacccccaaccuggcggagcgggugcuggacuggcucgagaaguacggcgucgagcgccugaagcggauggccaucuccggggacgacugcguggugaagccgaucgacgaccgcuucgccaccgcccugaccgcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcgcgggugagccagggggccggcuggagccuccgcgagacggccugccuggggaaguccuacgcccagauguggcagcugauguacuuccaccggcgcgaccuccggcuggcggccaacgccaucugcagcgccguccccguggacuggauccccaccucccgcaccaccuggagcauccacgcccaccaccaguggaugacgaccgaggacaugcuguccguguggaaccgcgucuggaucgaggagaaccccuggauggaggacaagacccacaucagcuccuggggcgacgugccguaccucgggaagcgggaggaccaguggugcggcagccugaucggccugaccgcgcgcgccacgugggccaccaacauccagguggccaucaaccagguccggcgccucaucgggaacgagaacuaccuggacuacaugaccuccaugaagcgguucaagaacgagagcgaccccgagggcgcccugugguga

SEQ ID NO: 8823 - RNA, 9879 nt, Artificial Sequence
  derived and/or modified CDS sequence (opt1) from DENV-1__JQ045639__SS-prME
agcgugaccauguuccugaugcucaugcccaccgcccuggccuuccaccugaccacccggggcggggagccccacaugaucgugagcaagcaggagcggggcaagagccuccuguucaagaccagcgccggggugaacaugugcacccugaucgccauggaccucggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccuggcgccccacgugggccucgggcuggagacccgcaccgagaccuggaugagcuccgagggcgccuggaagcagauccagcgggucgagacgugggcccugcgccaccccggguucaccgugaucgcccucuuccuggcccacgcgaucggcaccagcaucacccagaaggggaucaucuucauccugcucaugcuggugacgcccuccauggccaugcggugcgucggcaucggcagccgcgacuucguggaggggcuguccggcgccaccuggguggacgucgugcucgagcacgggagcugcgugaccaccauggccaaggacaagcccacgcuggacaucgagcugcucaagaccgaggucaccaaccccgccgugcugcggaagcugugcaucgaggcgaagaucuccaacaccacgaccgacagccgcugcccgacccagggcgaggccacccucguggaggagcaggacgccaacuucgucugccggcgcacguucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcugaccgacuacggggcccucacgcuggacugcagcccccgcaccggccuggacuucaacgagaugguccuccugaccaugaaggagaaguccuggcuggugcacaagcagugguuccucgaccugccccugcccuggaccagcggggccagcacgucccaggagaccuggaaccggcaggaccuccuggugaccuucaagaccgcccacgccaagaagcaggaggucguggugcugggcagccaggagggcgcgaugcacacggcccucaccggggccaccgagauccagaccuccggcacgaccaccaucuucgccgggcaccugaagugccgccugaagauggacaagcucacccugaagggcaugagcuacgucaugugcacgggguccuucaagcuggagaaggagcucgccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucguguggcacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggcccgggccucccaggaggggccgcuccccgagaucgaggacgagguguuccgcaagcggaaccugaccaucauggaccugcaccccggcagcgggaagacccgccgguaccucccggcgaucguccgcgaggccaucaagcgcaagcugcggacccugauccucgcccccacgcgcgugguggccuccgagauggccgaggcgcugaagggcaugcccauccgguaccagaccaccgccgucaagagcgagcacaccggcaaggagaucguggaccugaugugccacgccacguucaccaugcgccuccugucccccgugcgggucccgaacuacaacaugaucaucauggacgaggcccacuucaccgaccccagcuccaucgccgcgcgcggguacaucagcacccgggugggcaugggggaggccgccgccaucuucaugacggccacgccgcccggcuccguggaggcguucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggugauccucgccggccccaugccggucaccguggccuccgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagacguucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggaccuacuccgacccccucgcccugcgcgaguucaaggaguucgccgcgggccggcgcagcguguccggggaccugauccucgagaucggcaagcugccgcagcaccugacccagcgggcccagaacgcccucgacaaccuggucaugcugcacaacagcgagcagggcgggcgcgccuaccggcacgcgauggaggagcuccccgacacgaucgagacccugaugcugcucgcccugaucgccgugcugaccggcggggugacccucuucuuccuguccggccgcgggcugggcaagaccagcaucggccuccugugcgucauggccuccagcgcccugcucuggauggcguccguggagccccacuggaucgccgccagcaucauccuggaguucuuccugauggugcuccugauccccgagccggaccggcagcgcacgccccaggacaaccagcuggccuacgucgugaucgggcuccuguucaugauccugaccguggccgcgaacgagaugggccuccuggagaccaccaagaaggaccuggggaucggccacgccgccgucgagaaccaccaccacgccgccaugcucgacguggaccugcaccccgcguccgccuggacgcuguacgccguggccaccaccaucaucaccccgaugaugcgccacacgaucgagaacaccaccgccaacaucagccucaccgcgaucgccaaccaggccgccauccugauggggcuggacaagggcuggcccaucuccaagauggacaucggcgucccccuccuggcgcuggggugcuacagccaggugaacccccucacgcugaccgccgccgugcugaugcucgucgcccacuacgccaucaucggcccggggcugcaggcgaaggccacccgggaggcccagaagcgcaccgccgccggcaucaugaagaaccccacgguggacgggaucguggcgaucgaccuggaccccgucguguacgacgccaaguucgagaagcagcucggccagaucaugcugcugauccucugcaccucccagauccugcugaugcggaccaccugggcccucugcgagagcaucacgcuggccaccggcccccugaccacccucugggagggguccccgggcaaguucuggaacacgaccaucgccgugagcauggcgaacaucuuccgcggguccuaccuggccggcgccggccuggccuucagccucaugaagucccucgggggcgggcggcgcgggaccggggcgcagggcgagacccugggcgagaaguggaagcggcagcucaaccagcuguccaagagcgaguucaacacguacaagcgcuccgggaucauggaggucgaccggagcgaggccaaggagggccugaagcgcggggagaccaccaagcacgccgugucccggggcaccgccaagcuccgcugguucguggagcggaaccuggucaagcccgaggggaaggugaucgaccugggcugcggccgcgggggcuggagcuacuacugcgccgggcugaagaaggugacggaggucaagggcuacaccaagggcggccccggccacgaggagcccaucccgauggcgaccuacggguggaaccucgugaagcugcacuccggcaaggacguguucuucaucccgcccgagaagugcgacacccugcucugcgacaucggggagagcucccccaacccgacgaucgaggagggccggacccugcgcguccugaagaugguggagcccuggcuccgggggaaccaguucugcaucaagauccugaaccccuacaugcccagcguggucgagacccuggagcagaugcagcgcaagcacggcggcaugcucgugcggaacccgcugucccgcaacagcacccacgagauguacuggguguccugcgggaccggcaacaucgucagcgccgugaacaugacgucccgcaugcugcucaaccgguucaccauggcccaccgcaagcccaccuacgagcgggacguggaccugggggccggcacccgccacgucgccguggagcccgagguggcgaaccuggacaucaucggccagcggaucgagaacaucaagcacgagcacaagagcacguggcacuacgacgaggacaaccccuacaagaccugggccuaccacggguccuacgaggucaagccgagcggcuccgccagcagcauggugaacgggguggucaagcuccugaccaagcccugggacgugauccccauggucacccagaucgccaugacggacaccacccccuucggccagcagcgcguguucaaggagaagguggacacccggacgccgaaggccaagcgcgggaccgcgcagaucauggaggucaccgccaaguggcuguggggcuuccucucccggaacaagaagccccgcaucugcacccgggaggaguucacgcgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggcggugcgcgaccugcgucuacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccgcaucacggaggacgaccugcagaacgaggcgcggaucaccgacaucauggagccggagcacgcccuccuggccaaguccaucuucaagcugaccuaccagaacaaggugguccgcgugcagcggcccgccaagaacgggaccgugauggacgucaucagccgccgggaccagcgcggcuccggccagguggggacguacggccucaacaccuucaccaacauggaggcccagcugauccggcagauggagagcgaggggaucuucucccccagcgagcuggagacccccaaccucgcggagcgcgugcuggacuggcuggagaaguacggcgucgagcggcucaagcgcauggccaucuccggggacgacugcguggugaagccgaucgacgaccgguucgccacggcccugaccgcccugaacgacaugggcaagguccgcaaggacaucccccagugggagcccagcaagggguggaacgacuggcagcagguccccuucugcucccaccacuuccaccagcucaucaugaaggacggccgggagaucguggucccgugccgcaaccaggacgagcuggugggccgggcgcgcgugagccagggggccggcuggagccugcgggagaccgccugccucgggaaguccuacgcccagauguggcagcugauguacuuccaccgccgggaccugcgccucgcggccaacgccaucugcagcgccguccccguggacuggauccccaccucccgcacgaccuggagcauccacgcccaccaccaguggaugaccaccgaggacaugcuguccguguggaaccgggucuggaucgaggagaaccccuggauggaggacaagacgcacaucagcuccugggaggacgugccguaccugggcaagcgcgaggaccaguggugcgggagccucaucggccugaccgcgcgggccaccugggccaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8824 - RNA, 9879 nt, Artificial Sequence
  derived and/or modified CDS sequence (opt1) from DENV-1__JQ045641__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucgcccagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguucuuccuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucggccugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccacccugucccuccacuacgccuggaagaccauggcgauggugcugagcaucgucucccuguucccccucugccugagcacgaccucccagaagaccaccuggcugcccgugcuccugggcagccuggggugcaagccgcucacgauguuccugaucgccgagaacaagaucuggggccggcgcuccuggccccugaacgaggggaucauggccgugggcaucgucagcauccuccugagcucccugcucaagaacgacgugccccuggccgggccccugaucgccggcggcaugcucaucgcgugcuacgugaucagcggguccagcgccgaccugucccuggagaaggccgccgaggucagcugggaggaggaggccgagcacuccggcgcgagccacaacauccucguggaggugcaggacgacgggaccaugaagaucaaggacgaggagcgggacgacacccugaccauccugcucaaggccacccugcuggccgucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgcggugcugauguaccaggggaagcgccucgagcccagcugggccuccgucaagaaggaccugaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcucgacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucguccgggaggccaucaagcgcaagcuccgcacccugauccuggcccccacccgggugguggccuccgagauggcggaggcccucaagggcaugcccauccgcuaccagacgaccgccgucaagagcgagcacaccggcaaggagaucguggaccugaugugccacaccacguucaccaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccucaagcccgugauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccuguucaugauccugaccgucgccgccaacgagaugggccugcucgagaccaccaagaaggaccuggggaucggccacguggcgguggagaaccaccaccacgccgccaugcuggacgucgaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggucaacccccugacgcucaccgccgcggugcugaugcugguggcccacuacgccaucaucggcccggggcuccaggccaaggccacccgcgaggcgcagaagcggaccgccgccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggucucccgcggcaccgccaagcugcggugguucguggagcgcaaccuggugaagcccgaggggaaggucaucgaccucggcugcggccgcggcggguggagcuacuacugcgccgggcugaagaaggugacggaggugaagggguacaccaagggcggccccggccacgaggagcccaucccgauggccaccuacggguggaaccuggucaagcuccacuccggcaaggacguguucuucaucccgcccgagaagugcgacacccugcugugcgacaucggggagagcucccccaacccgacgaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggaccggcaacaucgugagcgccgucaacaugacgucccgcaugcugcugaaccgcuucaccauggcgcaccggaagcccaccuacgagcgcgacguggaccucggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcucaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcucauccggcagauggagagcgaggggaucuucucccccagcgagcuggagacccccaaccuggccgagcgcgugcucgacuggcuggagaaguacggcguggagcggcugaagcgcauggccaucuccggggacgacugcgucgugaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgcgugccuggggaaguccuacgcccagauguggcagcucauguacuuccaccgccgggaccugcgccuggccgccaacgcgaucugcagcgccgugcccgucgacuggauccccaccucccggacgaccuggagcauccacgcccaccaccaguggaugaccaccgaggacaugcucuccguguggaaccgcguguggaucgaggagaaccccuggauggaggacaagacgcacaucagcuccuggggcgacgucccguaccuggggaagcgcgaggaccaguggugcggcagccugaucggccucaccgcccgggccaccugggcgaccaacauccagguggccaucaaccaggugcgccggcugaucgggaacgagaacuaccuggacuacaugaccuccaugaagcgcuucaagaacgagagcgaccccgagggcgcccucugguga

SEQ ID NO: 8825 - RNA, 9879 nt, Artificial Sequence
  derived and/or modified CDS sequence (opt1) from DENV-1__JQ045642__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccagugcgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccucuucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccacguucaagaugcggccgauguucgccguggggcuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccaugguccugagcaucgugucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgucggcaucgugagcauccugcugagcucccuccugaagaacgacgugccccuggccgggccccucaucgccggcggcaugcugaucgccugcuacgucaucagcggguccagcgcggaccugucccucgagaaggccgccgaggugagcugggaggaggaggccgagcacuccggcgccagccacaacauccugguggagguccaggacgacgggaccaugaagaucaaggacgaggagcgggacgacacccugaccauccuccugaaggcgacgcugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacaccauguggcacgugacgcgcggggccguccucauguaccagggcaagcgccuggagcccagcugggcguccgugaagaaggaccugaucagcuacggcgggggcuggcggcuccagggguccuggaacaccggcgaggaggugcaggucaucgccguggagcccgggaagaaccccaagaacgugcagaccgcccccggcaccuucaagacgcccgagggcgaggucggggccaucgcccuggacuucaagcccggcaccagcgggucccccaucgugaaccgcgagggcaagaucgugggccuguacgggaacggcgucgugaccaccagcgggacguacgugagcgcgaucgcccaggccaaggccucccaggagggcccgcuccccgagaucgaggacgaggucuuccggaagcgcaaccugaccaucauggaccugcaccccgggagcggcaagacccggcgcuaccucccggcgaucgugcgggaggccaucaagcgcaagcugcgcacccugauccucgcccccacgcggguggucgccuccgagauggccgaggcgcugaagggcaugcccauccgcuaccagaccaccgccgucaagagcgagcacaccgggaaggagaucguggaccugaugugccacgccacguucaccaugcggcuccugucccccguccgcgugccgaacuacaacaugaucaucauggacgaggcccacuucaccgaccccagcuccaucgccgcgcggggcuacaucagcacccgcguggggaugggcgaggccgccgccaucuucaugacggccacgccgcccggguccgucgaggcguucccgcagagcaacgccgugauccaggacgaggagcgggacauccccgagcgcuccuggaacagcggcuacgaguggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgugauccugaaggacggccccgagcgcgucauccucgccgggcccaugccggugaccgucgccuccgccgcccagcggcgcggccggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggggaggcgcggaagacguucguggagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgccgcggggcgccggagcgucuccggcgaccugauccucgagaucggcaagcugccgcagcaccugacccagcgcgcccagaacgcccucgacaaccuggugaugcugcacaacagcgagcagggcgggcgggccuaccgccacgcgauggaggagcuccccgacacgaucgagacccugaugcugcucgcccugaucgccgugcugaccgggggcgucacccucuucuuccuguccgggcggggccugggcaagaccagcaucgggcuccugugcgugauggccuccagcgugcugcucuggauggccuccgucgagccccacuggaucgcggccagcaucauccuggaguucuuccugauggugcuccugauccccgagccggaccgccagcggacgccccaggacaaccagcuggccuacguggucaucggccuccuguucaugauccugaccguggccgccaacgagauggggcuccuggagaccaccaagaaggaccugggcaucgggcacguggcggucgagaaccaccaccacgccgccaugcucgacguggaccugcaccccgccuccgccuggacgcuguacgcgguggccaccaccaucaucaccccgaugaugcgccacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccccucacgcugaccgccgcggugcugaugcucgucgcccacuacgccaucaucgggccgggccugcaggccaaggccacccgcgaggcgcagaagcggaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccggggaaguucuggaacacgaccaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggccaaggaggggcugaagcggggcgagaccaccaagcacgcggugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcaccgggaacaucgucagcgccgugaacaugacgucccgcaugcugcucaaccgcuucaccauggcgcaccggaagcccaccuacgagcgcgacguggaccugggcgccggcacccggcacgucgccguggagcccgagguggccaaccuggacaucaucgggcagcgcaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccggaucacggaggacgaccugcagaacgaggcccgcaucaccgacaucauggagccggagcacgcccuccuggcgaaguccaucuucaagcugaccuaccagaacaaggugguccgcgugcagcggcccgccaagaacggcaccgugauggacgucaucagccgccgggaccagcgcggguccggccaggugggcacguacgggcucaacaccuucaccaacauggaggcccagcugauccggcagauggagagcgagggcaucuucucccccagcgagcuggagacccccaaccucgccgagcgcgugcuggacuggcuggagaaguacggggucgagcggcucaagcgcauggccaucuccggcgacgacugcguggugaagccgaucgacgaccgguucgcgacggcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgcgugccucggcaaguccuacgcccagauguggcagcugauguacuuccaccgccgggaccugcgccucgccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccugggcaagcgcgaggaccaguggugcggcagccucaucgggcugaccgcccgggccaccugggcgaccaacauccagguggccaucaaccagguccgccggcugaucggcaacgagaacuaccucgacuacaugaccuccaugaagcgcuucaagaacgagagcgaccccgagggggcccugugguga

SEQ ID NO: 8826 - RNA, 9879 nt, Artificial Sequence
  derived and/or modified CDS sequence (opt1) from DENV-1__JQ045644__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgcguggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgccaacgcgagcgaccgcauggggaugggcaccaccuaccuggcccugauggccgccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugaccauccuccugaaggccacccugcucgccguguccggcguguacccgcugagcauccccgccacgcuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacccggggcgcgguccucauguaccaggggaagcgccuggagcccagcugggccuccgugaagaaggaccugaucagcuacggcggcggguggcggcuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccuguacggcaacggggucgugaccaccagcggcaccuacgugagcgccaucgcccaggccaaggcgucccaggaggggccgcuccccgagaucgaggacgaggucuuccggaagcgcaaccugacgaucauggaccugcaccccggcagcgggaagacccggcgcuaccucccggccaucgugcgggaggccaucaagcgcaagcugcgcacccugauccucgcccccacccggguggucgccuccgagauggcggaggcccugaagggcaugcccauccgcuaccagacgaccgccgucaagagcgagcacaccggcaaggagaucguggaccugaugugccacgccaccuucacgaugcggcuccugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccugcggaagaacgggaagcgcgugauccagcucucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccugaaggacgggcccgagcgcgucauccucgccggccccaugccggugacggucgccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucguggagcucaugcgccgcggggaccugcccguguggcuguccuacaaggucgccagcgagggcuuccaguacagcgaccgccgguggugcuucgacggcgagcgcaacaaccaggugcucgaggagaacauggacguggagaucuggacgaaggagggggagcggaagaagcugcgcccccgguggcuggacgcccgcaccuacuccgacccccucgcccugcgggaguucaaggaguucgcggccggccgccggagcgucuccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacaccaucgagacgcugaugcugcucgcccugaucgccgugcugaccggcggggucacccucuucuuccuguccggccgggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgcgaggcccagaagcggaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggccaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcgggaaccaguucugcaucaagauccugaaccccuacaugcccagcguggucgagacccuggagcagaugcagcggaagcacggcggcaugcucgugcgcaacccgcugucccggaacagcacccacgagauguacuggguguccugcgggaccggcaacaucgucagcgcggugaacaugaccucccgcaugcugcucaaccgcuucacgauggcccaccggaagcccaccuacgagcgcgacguggaccugggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgaaguggcuguggggcuuccucucccgcaacaagaagccccggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggcccgcaucacggacaucauggagccggagcacgcgcuccuggcccgcuccaucuucaagcugaccuaccagaacaaggugguccgggugcagcgccccgccaagaacgggaccgugauggacgucaucagccggcgcgaccagcggggcuccggccagguggggaccuacggccucaacacguucaccaacauggaggcccagcugauccgccagauggagagcgaggggaucuucucccccagcgagcuggagacccccaaccucgccgagcgggugcuggacuggcuggagaaguacggcgucgagcgccucaagcggauggcgaucuccggggacgacugcguggugaagccgaucgacgaccgcuucgccaccgcccugacggcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggagccugcgcgagaccgccugccucgggaaguccuacgcccagauguggcagcugauguacuuccaccggcgcgaccugcggcucgccgcgaacgccaucugcagcgccguccccguggacuggauccccaccucccgcaccacguggagcauccacgcccaccaccaguggaugaccaccgaggacaugcuguccguguggaaccgcgucuggaucgaggagaaccccuggauggaggacaagacccacaucagcuccuggggcgacgugccguaccuggggaagcgggaggaccaguggugcggcagccucaucggccugacggcccgcgcgaccugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 8827 - RNA, 9879 nt, Artificial Sequence
  derived and/or modified CDS sequence (opt1) from DENV-1__JQ045648__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucgcccagaacggccggcugaucaccgccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguucuuccuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucggccugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccacccugucccuccacuacgccuggaagaccauggcgauggugcugagcaucgucucccuguucccccucugccugagcacgaccucccagaagaccaccuggcugcccgugcuccugggcagccuggggugcaagccgcucacgauguuccugaucgccgagaacaagaucuggggccggcgcuccuggccccugaacgaggggaucauggccgugggcaucgucagcauccuccugagcucccugcucaagaacgacgugccccuggccgggccccugaucgccggcggcaugcucaucgcgugcuacgugaucagcggguccagcgccgaccugucccuggagaaggccgccgaggucagcugggaggaggaggccgagcacuccggcgcgagccacaacauccucguggaggugcaggacgacgggaccaugaagaucaaggacgaggagcgggacgacacccugaccauccugcucaaggccacccugcuggccgucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgcggugcugauguaccaggggaagcgccucgagcccagcugggccuccgucaagaaggaccugaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcucgacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucguccgggaggccaucaagcgcaagcuccgcacccugauccuggcccccacccgggugguggccuccgagauggcggaggcccucaagggcaugcccauccgcuaccagacgaccgccgucaagagcgagcacaccggcaaggagaucguggaccugaugugccacaccacguucaccaugcggcugcucucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccucaagcccgugauccugaaggacgggcccgagcgcgugauccuggccggccccaugccggucaccguggccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucgucgagcugaugcgccgcggggaccuccccguguggcuguccuacaagguggccagcgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgucaugcugcacaacagcgagcagggcgggcgggccuaccgccacgcgauggaggagcugcccgacacgaucgagacccucaugcugcuggcccucaucgccgugcugaccggcggggugacccuguucuuccucuccggccgggggcugggcaagaccagcaucggccugcucugcgucauggccuccagcgugcugcuguggauggccuccguggagccccacuggaucgcggccagcaucauccucgaguucuuccugaugguccugcucauccccgagccggaccgccagcggacgccccaggacaaccagcuggccuacguggugaucgggcuccuguucaugauccugaccgucgccgccaacgagaugggccugcucgagaccaccaagaaggaccuggggaucggccacguggcgguggagaaccaccaccacgccgccaugcuggacgucgaccuccaccccgccuccgccuggacgcuguacgcgguggccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggucaacccccugacgcucaccgccgcggugcugaugcugguggcccacuacgccaucaucggcccggggcuccaggccaaggccacccgcgaggcgcagaagcggaccgccgccggcaucaugaagaaccccacggucgacgggaucguggccaucgaccuggaccccguggucuacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgugagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggucucccgcggcaccgccaagcugcggugguucguggagcgcaaccuggugaagcccgaggggaaggucaucgaccucggcugcggccgcggcggguggagcuacuacugcgccgggcugaagaaggugacggaggugaagggguacaccaagggcggccccggccacgaggagcccaucccgauggccaccuacggguggaaccuggucaagcuccacuccggcaaggacguguucuucaucccgcccgagaagugcgacacccugcugugcgacaucggggagagcucccccaacccgacgaucgaggagggccgcacccuccgggugcugaagauggucgagcccuggcugcgcgggaaccaguucugcaucaagauccucaaccccuacaugcccagcgugguggagacccuggagcagaugcagcggaagcacggcggcaugcugguccgcaacccgcucucccggaacagcacccacgagauguacuggguguccugcgggaccggcaacaucgugagcgccgucaacaugacgucccgcaugcugcugaaccgcuucaccauggcgcaccggaagcccaccuacgagcgcgacguggaccucggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcugcucaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccugucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaagguggugcgcguccagcggcccgccaagaacgggaccgugauggacgugaucagccgccgggaccagcgcggcuccgggcaggucggcacguacggccugaacaccuucaccaacauggaggcccagcucauccggcagauggagagcgaggggaucuucucccccagcgagcuggagacccccaaccuggccgagcgcgugcucgacuggcuggagaaguacggcguggagcggcugaagcgcauggccaucuccggggacgacugcgucgugaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcucgucggccgggcccgcgugagccagggggccggcuggagccugcgggagaccgcgugccuggggaaguccuacgcccagauguggcagcucauguacuuccaccgccgggaccugcgccuggccgccaacgcgaucugcagcgccgugcccgucgacuggauccccaccacgugcaccaccugguccauccacgcccaccaccaguggaugaccacggaggacaugcucagcguguggaaccggguguggaucgaggagaaccccuggauggaggacaagacccacaucuccagcuggggcgacgucccguaccuggggaagcgcgaggaccaguggugcggcucccugaucggccucaccgcccgcgccaccugggcgaccaacauccagguggccaucaaccaggugcggcgccugaucgggaacgagaacuaccuggacuacaugacgagcaugaagcgguucaagaacgaguccgaccccgagggcgcccucugguga

SEQ ID NO: 8828 - RNA, 9879 nt, Artificial Sequence
  derived and/or modified CDS sequence (opt1) from DENV-1__JQ045649__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacaccaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucacggugguggucggggacguggccggcauccucgcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccguccgggagaaggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacgcuggccguguucuuccugcucaucgucgggcagcugaccuggaacgaccugauccgccucugcaucauggugggcgccaacgcgagcgaccggauggggaugggcaccaccuaccuggcccugauggccacguucaagaugcgcccgauguucgccgugggccuccuguuccggcgccugaccucccgggagguccuccugcugaccaucgggcucagccugguggccuccgucgagcugcccaacagccucgaggagcugggcgacgggcuggcgaugggcaucaugauccucaagcugcugaccgacuuccagucccaccagcucugggccagccugcugucccucacguucaucaagaccaccuucagccugcacuacgccuggaagaccauggccauggugcuguccguggucagccucuucccccugugccuguccacgaccagccagaagaccaccuggcuccccgugcugcugggcucccucgggugcaagccgcugacgauguuccugaucgcggagaacaagaucuggggccgccggagcuggccccucaacgaggggaucauggccgugggcaucgucagcauccugcuguccagccuccugaagaacgacgugccccuggccgggccccucaucgccggcggcaugcugaucgccugcuacgugaucuccgggagcuccgcggaccugagccucgagaaggccgccgaggucuccugggaggaggaggccgagcacagcggcgccucccacaacauccugguggaggugcaggacgacgggaccaugaagaucaaggacgaggagcgcgacgacacccugaccauccuccugaaggcgacccugcucgccgucagcggcguguacccgcuguccauccccgccacgcuguucgugugguacuucuggcagaagaagaagcagcggagcgggguccucugggacacccccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgccgugcucauguaccaggggaagcggcuggagcccuccugggcgagcgucaagaaggaccugaucuccuacggcggcggguggcgccuccagggcagcuggaacacgggggaggagguccaggugaucgccgucgagcccggcaagaaccccaagaacgugcagaccgcccccgggaccuucaagacccccgagggcgaggugggcgccaucgcccuggacuucaagcccgggacguccggcagccccaucgucaaccgggaggggaagaucgugggccuguacggcaacgggguggucaccaccagcggcaccuacguguccgcgaucgcccaggccaaggccagccaggaggggccgcuccccgagaucgaggacgagguguuccgcaagcggaaccugacgaucauggaccugcaccccggcuccgggaagacccgccgguaccucccggcgaucguccgcgaggccaucaagcgcaagcugcggacccugauccucgcccccacccgcgugguggccagcgagauggccgaggcgcugaagggcaugcccauccgguaccagacgaccgccgucaaguccgagcacaccggcaaggagaucguggaccugaugugccacgccaccuucacgaugcgccuccugagccccgugcgggucccgaacuacaacaugaucaucauggacgaggcccacuucaccgaccccuccagcaucgccgcgcgcggguacaucuccacccgggugggcaugggggaggccgccgccaucuucaugaccgccacgccgcccggcagcguggaggcguucccgcaguccaacgccgucauccaggacgaggagcgcgacauccccgagcggagcuggaacuccggguacgaguggaucaccgacuuccccggcaagaccgugugguucgugcccagcaucaaguccggcaacgacaucgccaacugccugcgcaagaacgggaagcgggucauccagcucagccgcaagaccuucgacacggaguaccagaagaccaagaacaacgacugggacuacguggugaccaccgacaucuccgagaugggcgccaacuuccgggcggaccgcgucaucgacccgcggcgcugccugaagcccgugauccugaaggacgggcccgagcgggucauccucgccggccccaugccggugacgguggccagcgccgcccagcgccgggggcgcaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgggagaaguccgccgccaucgacggggaguaccgccugcggggcgaggcgcgcaagaccuucgucgagcucaugcggcgcggggaccugcccguguggcugagcuacaagguggccagcgagggcuuccaguacuccgaccggcgcuggugcuucgacggcgagcggaacaaccagguccucgaggagaacauggacguggagaucuggacgaaggagggggagcgcaagaagcugcggccccgcuggcuggacgcccggaccuacagcgacccccucgcccugcgcgaguucaaggaguucgccgcgggccggcgcuccgugagcggggaccugauccucgagaucggcaagcugccgcagcaccugacccagcgggcccagaacgcccucgacaaccuggucaugcugcacaacuccgagcagggcgggcgcgccuaccggcacgcgauggaggagcuccccgacaccaucgagacgcugaugcugcucgcccugaucgccgugcugaccggcggggugacccucuucuuccugagcggccgcgggcugggcaagaccuccaucggccuccugugcgucauggccagcuccgugcugcucuggauggccagcguggagccccacuggaucgcggccuccaucauccuggaguucuuccugaugguccuccugauccccgagccggaccggcagcgcacgccccaggacaaccagcuggccuacguggugaucgggcuccuguucaugauccugacggucgccgccaacgagaugggccuccuggagaccaccaagaaggaccuggggaucggccacguggcgguggagaaccaccaccacgccgccaugcucgacgucgaccugcaccccgccagcgccuggacccuguacgcgguggccacgaccaucaucaccccgaugaugcgccacaccaucgagaacacgaccgccaacaucucccucaccgccaucgccaaccaggcggccauccugauggggcuggacaagggcuggcccaucagcaagauggacaucggcgugccccuccuggcccuggggugcuacucccaggucaacccccucacccugacggccgcggugcugaugcucguggcccacuacgccaucaucggcccggggcugcaggccaaggccacccgggaggcgcagaagcgcaccgccgccggcaucaugaagaaccccaccgucgacgggaucguggccaucgaccuggaccccguggucuacgacgccaaguucgagaagcagcucggccagaucaugcugcugauccucugcacgagccagauccugcugaugcggaccaccugggcgcucugcgaguccaucacccuggccacgggcccccugaccacccucugggaggggagcccgggcaaguucuggaacaccacgaucgccguguccauggccaacaucuuccgcgggagcuaccuggccggcgcgggccuggccuucagccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggccaaggagggccugaagcgcggggagacgaccaagcacgcggucagccggggcaccgccaagcuccgcugguucguggagcggaaccuggugaagcccgaggggaaggucaucgaccugggcugcggccgcgggggcugguccuacuacugcgccgggcugaagaaggugaccgaggugaagggcuacacgaagggcgggcccggccacgaggagcccaucccgauggccaccuacggguggaaccucgucaagcugcacagcggcaaggacguguucuucaucccgcccgagaagugcgacacccugcucugcgacaucggggaguccagccccaacccgaccaucgaggagggccggacgcugcgcgugcugaagauggucgagcccuggcuccgggggaaccaguucugcaucaagauccugaaccccuacaugcccuccgugguggagacccuggagcagaugcagcgcaagcacggcggcaugcucguccggaacccgcugagccgcaacuccacccacgagauguacugggugagcugcgggaccggcaacaucguguccgccgucaacaugaccagccgcaugcugcucaaccgguucacgauggcgcaccgcaagcccaccuacgagcgggacguggaccugggggccggcacccgccacguggccgucgagcccgagguggccaaccuggacaucaucggccagcggaucgagaacaucaagcacgagcacaaguccaccuggcacuacgacgaggacaaccccuacaagacgugggccuaccacgggagcuacgaggucaagccguccggcagcgcgagcuccauggugaacgggguggucaagcuccugaccaagcccugggacgugauccccauggugacccagaucgccaugaccgacacgacccccuucggccagcagcgcgucuucaaggagaagguggacacccggaccccgaaggccaagcgcgggacggcccagaucauggaggugaccgccaaguggcuguggggcuuccucagccggaacaagaagccccgcaucugcacccgggaggaguucacccgcaagguccgguccaacgcggccaucggcgccguguucguggacgagaaccaguggaacagcgccaaggaggcggucgaggacgagcgcuucugggaccuggugcaccgggagcgcgagcugcacaagcaggggaagugcgccacgugcguguacaacaugaugggcaagcgggagaagaagcucggggaguucggcaaggccaaggggucccgcgccaucugguacauguggcugggcgcccgguuccuggaguucgaggcgcucggcuucaugaacgaggaccacugguucagccgcgagaacucccugagcggggucgagggcgaggggcugcacaagcucggcuacauccugcgggacaucuccaagauccccgggggcaacauguacgccgacgacaccgccggcugggacacccgcaucaccgaggacgaccugaagaacgaggcccgcaucacggacaucauggagccggagcacgcccuccuggccaaguccaucuucaagcugaccuaccagaacaagguggugcggguccagcgccccgccaagaacgggaccgugauggacgugaucucccggcgcgaccagcggggcagcgggcaggucggcaccuacggccucaacacguucaccaacauggaggcccagcugauccgccagauggaguccgaggggaucuucagccccuccgagcuggagacccccaaccucgccgagcgggugcugcacuggcuggagaaguacggcguggagcgccucaagcggauggccaucagcggggacgacugcgucgugaagccgaucgacgaccgcuucgcgaccgcccugacggcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcccgggugagccagggggccggcuggucccugcgcgagaccgcgugccucggcaagagcuacgcccagauguggcagcugauguacuuccaccggcgcgaccugcggcucgccgccaacgcgaucugcuccgccgugcccgucgacuggauccccaccagccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccuggggaagcgggaggaccaguggugcggcucccucaucggccugacggcccgcgccaccugggcgaccaacauccagguggccaucaaccaggugcggcgccugaucgggaacgagaacuaccucgacuacaugaccagcaugaagcgguucaagaacgaguccgaccccgagggcgcccugugguga

SEQ ID NO: 8829 - RNA, 9879 nt, Artificial Sequence
  derived and/or modified CDS sequence (opt1) from DENV-1__JQ045650__SS-prME
uccgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacacgaugaccuacaagugcccccgcaucaccgagaccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugcgggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacgcuggccguguucuuccuccugaucguggggcagcugaccuggaacgaccucauccgccugugcaucauggucggcgccaacgcgagcgaccggauggggaugggcaccaccuaccuggcccucauggccacguucaagaugcgcccgauguucgccgugggccugcuguuccggcgccucaccucccgggaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccagccugcucucccugacguucaucaagaccaccuucagccugcacuacgccuggaagaccauggccaugguccucuccguggugagccuguucccccugugccucuccacgaccagccagaagaccaccuggcugcccguccugcucggcucccuggggugcaagccgcugacgauguuccucaucgcggagaacaagaucuggggccgccggagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggaccaugaagaucaaggacgaggagcgcgacgacacccucaccauccugcugaaggcgacccuccuggccgugagcggcgucuacccgcuguccauccccgccacccuguucgugugguacuucuggcagaagaagaagcagcggagcggggugcugugggacacccccagcccgcccgaggucgagcgcgccgugcuggacgacggcaucuaccggaucaugcagcgcggccugcucgggcggagccaggugggcgucgggguguuccaggagaacguguuccacaccauguggcacgucacccgcggcgccgugcugauguaccaggggaagcggcuggagcccuccugggcgagcgugaagaaggaccucaucuccuacggcggcggguggcgccugcagggcagcuggaacacgggggaggagguccaggugaucgccguggagcccggcaagaaccccaagaacguccagaccgcccccgggaccuucaagacccccgagggcgaggugggcgccaucgcccuggacuucaagcccgggacguccggcagccccaucgugaaccgggaggggaagaucgucggccucuacggcaacgggguggugaccaccagcggcaccuacgucuccgcgaucgcccaggccaaggccagccaggaggggccgcugcccgagaucgaggacgagguguuccgcaagcggaaccugacgaucauggaccuccaccccggcuccgggaagacccgccgguaccugccggcgaucgugcgcgaggccaucaagcgcaagcugcggacccucauccuggcccccacccgcgucguggccagcgagauggccgaggcgcugaagggcaugcccauccgguaccagacgaccgccgugaaguccgagcacaccggcaaggagaucgucgaccucaugugccacgccaccuucacgaugcgccugcugagccccgugcgggugccgaacuacaacaugaucaucauggacgaggcccacuucaccgaccccuccagcaucgccgcgcgcggguacaucuccacccgggucggcaugggggaggccgccgccaucuucaugaccgccacgccgcccggcagcguggaggcguucccgcaguccaacgccgugauccaggacgaggagcgcgacauccccgagcggagcuggaacuccggguacgaguggaucaccgacuuccccggcaagaccgucugguucgugcccagcaucaaguccggcaacgacaucgccaacugccuccgcaagaacgggaagcgggugauccagcugagccgcaagaccuucgacacggaguaccagaagaccaagaacaacgacugggacuacgucgugaccaccgacaucuccgagaugggcgccaacuuccgggcggaccgcgugaucgacccgcggcgcugccugaagcccgucauccucaaggacgggcccgagcgggugauccuggccggccccaugccggucacgguggccagcgccgcccagcgccgggggcgcaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgggagaaguccgccgccaucgacggggaguaccgccuccggggcgaggcgcgcaagaccuucguggagcugaugcggcgcggggaccugcccgucuggcucagcuacaagguggccagcgagggcuuccaguacuccgaccggcgcuggugcuucgacggcgagcggaacaaccaggugcuggaggagaacauggacgucgagaucuggacgaaggagggggagcgcaagaagcugcggccccgcuggcucgacgcccggaccuacagcgacccccuggcccugcgcgaguucaaggaguucgccgcgggccggcgcuccgugagcggggaccucauccuggagaucggcaagcugccgcagcaccucacccagcgggcccagaacgcccuggacaaccuggugaugcuccacaacuccgagcagggcgggcgcgccuaccggcacgcgauggaggagcugcccgacaccaucgagacgcugaugcuccuggcccugaucgccguccucaccggcggggugacccuguucuuccugagcggccgcgggcucggcaagaccuccaucggccugcugugcgugauggccagcuccguccuccuguggauggccagcguggagccccacuggaucgcggccuccaucauccuggaguucuuccucauggugcugcugauccccgagccggaccggcagcgcacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccgccaugcuggacguggaccugcaccccgccagcgccuggacccucuacgcggucgccacgaccaucaucaccccgaugaugcgccacaccaucgagaacacgaccgccaacaucucccugaccgccaucgccaaccaggcggccauccugauggggcucgacaagggcuggcccaucagcaagauggacaucggcgugccccugcuggcccucgggugcuacucccaggugaacccccugacccugacggccgcgguccucaugcugguggcccacuacgccaucaucggcccggggcugcaggccaaggccacccgggaggcgcagaagcgcaccgccgccggcaucaugaagaaccccaccguggacgggaucgucgccaucgaccucgaccccgugguguacgacgccaaguucgagaagcagcugggccagaucaugcugcucauccugugcacgagccagauccugcucaugcggaccaccugggcgcugugcgaguccaucacccuggccacgggcccccucaccacccugugggaggggagcccgggcaaguucuggaacaccacgaucgccgucuccauggccaacaucuuccgcgggagcuaccuggccggcgcgggccucgccuucagccugaugaagucccucgggggcgggcggcgcgggaccggggcccagggcgagacccucggcgagaaguggaagcggcagcugaaccagcugagcaaguccgaguucaacaccuacaagcgcagcgggaucauggagguggaccgguccgaggccaaggagggccucaagcgcggggagacgaccaagcacgcggugagccggggcaccgccaagcugcgcugguucgucgagcggaaccuggugaagcccgaggggaaggugaucgaccugggcugcggccgcgggggcugggccuacuacugcgccgggcucaagaaggucaccgaggugaagggcuacacgaagggcggccccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccggacgcugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugaccucccgcaugcuccugaaccgguucacgauggcccaccgcaagcccaccuacgagcgggacgucgaccugggggccggcacccgccacguggccguggagcccgaggucgccaaccucgacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcgcguguucaaggagaaggucgacacccggaccccgaaggccaagcgcgggacggcccagaucauggaggugaccgcgaaguggcucuggggcuuccugucccggaacaagaagccccgcaucugcacccgggaggaguucacccgcaaggugcggagcaacgccgccaucggcgccgucuucguggacgagaaccaguggaacuccgcgaaggaggccguggaggacgagcgcuucugggaccugguccaccgggagcgcgagcuccacaagcaggggaagugcgccacgugcguguacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccucaagaacgaggcccgcaucacggacaucauggagccggagcacgcgcugcuggccaaguccaucuucaagcucaccuaccagaacaaggucgugcgggugcagcgccccgccaagaacgggaccgucauggacgugaucagccggcgcgaccagcggggcuccggccagguggggaccuacggccugaacacguucaccaacauggaggcccagcugauccgccagauggagagcgaggggaucuucucccccagcgagcucgagacccccaaccuggccgagcggguccugcacuggcucgagaaguacggcguggagcgccugaagcggauggcgaucuccggggacgacugcguggucaagccgaucgacgaccgcuucgccaccgcccugacggcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggcgggcuggagccuccgcgagaccgccugccuggggaaguccuacgcccagauguggcagcugauguacuuccaccggcgcgaccuccggcuggccgcgaacgccaucugcagcgccgugcccguggacuggauccccaccucccgcaccacguggagcauccacgcccaccaccaguggaugaccaccgaggacaugcuguccgucuggaaccgcguguggaucgaggagaaccccuggauggaggacaagacccacaucagcuccuggggcgacgugccguaccucgggaagcgggaggaccaguggugcggcagccugaucggccugacggcccgcgcgaccugggccaccaacauccaggucgccaucaaccaggugcggcgccucaucgggaacgagaacuaccuggacuacaugaccuccaugaagcgguucaagaacgagagcgaccccgagggcgcccugugguga

SEQ ID NO: 8830 - RNA, 9879 nt, Artificial Sequence
  derived and/or modified CDS sequence (opt1) from DENV-1__JQ045651__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaaguacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucgugccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggccaucuccggggacgacugcguggugaagccgaucgacgaccgguucgcgacggcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccugggaggacgugccguaccucggcaagcgcgaggaccaguggugcgggagccugaucggccugaccgcccgggccaccugggcgaccaacauccagguggccaucaaccagguccgccggcucaucggcaacgagaacuaccuggacuacaugaccuccaugaagcgcuucaagaacgagagcgaccccgagggggcccugugguga

SEQ ID NO: 8831 - RNA, 9879 nt, Artificial Sequence
  derived and/or modified CDS sequence (opt1) from DENV-1__JQ045652__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugccccacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgccaacgcgagcgaccgcauggggaugggcaccaccuaccuggcccucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgucucccuguucccccugugccucagcaccaccucccagaagaccacguggcugcccgugcugcucggcagccuggggugcaagccgcugaccauguuccucaucgcggagaacaagaucuggggccggcgcuccuggccccugaacgaggggaucauggccgugggcaucgucagcauccugcucagcucccugcugaagaacgacgugccccucgccgggccccugaucgccggcggcaugcugaucgccugcuacgugaucagcggguccagcgcggaccucucccuggagaaggccgccgaggucagcugggaggaggaggccgagcacuccggcgccagccacaacauccugguggaggugcaggacgacgggaccaugaagaucaaggacgaggagcgggacgacacccucaccauccugcugaaggcgacgcuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacgcggggcgccgugcugauguaccaggggaagcgccuggagcccagcugggcguccgucaagaaggaccucaucagcuacggcggcggguggcggcugcagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccucuacggcaacgggguggucaccaccagcggcacguacgugagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucguccgggaggccaucaagcgcaagcugcgcacccucauccuggcccccacgcgggugguggccuccgagauggccgaggcgcugaagggcaugcccauccgcuaccagaccaccgccgucaagagcgagcacaccggcaaggagaucguggaccucaugugccacgccacguucaccaugcggcugcugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccucaaggacgggcccgagcgcgugauccuggccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaaguacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucgugccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcgcaccggaagcccaccuacgagcgcgacguggaccugggggccggcacccggcacgucgccguggagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgccaaguggcucuggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcccgcaucaccgacaucauggagccggagcacgcccugcuggcgaaguccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggccaucuccggggacgacugcguggugaagccgaucgacgaccgguucgcgacggcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucgggaagcgcgaggaccaguggugcggcagccugaucggccugaccgcccgggccaccugggcgaccaacauccagguggccaucaaccagguccgccggcucaucgggaacgagaacuaccuggacuacaugaccuccaugaagcgcuucaagaacgagagcgaccccgagggcgcccugugguga

SEQ ID NO: 8832 - RNA, 9879 nt, Artificial Sequence
  derived and/or modified CDS sequence (opt1) from DENV-1__JQ045653__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacgcugguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgccaccaucacgccccaggcgcccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgccaagaagcaggaggucguggugcugggcagccaggagggcgcgaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagcuggccgagacccagcacggcaccgugcuggugcagaucaaguacgagggcaccgacgcgcccugcaagauccccuucagcacgcaggacgagaagggggucacccagaacggccggcucaucaccgccaacccgaucgugaccgacaaggagaagcccgugaacaucgaggccgagccgcccuucggggaguccuacaucgucaucggcgccggcgagaaggcgcugaagcugagcugguucaagaagggguccagcaucggcaagauguucgaggccacggcccgcggggcccggcgcauggccauccucggcgacaccgcgugggacuucggguccaucggcggcguguucaccagcguggggaagcugguccaccagaucuucggcaccgccuacggggugcuguucuccggcgugagcuggacgaugaagaucgggaucggcguccuccugaccuggcugggccucaacucccgcagcaccucccugagcaugaccugcaucgccguggggcuggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccucuccgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaucuggccccgcucccacacccuguggagcaacggcguccuggaguccgagaugaucauccccaagaucuacgggggcccgaucagccagcacaacuaccggcccggguacuucacccagaccgccggccccuggcaccucgggaagcuggagcuggacuucgaccucugcgagggcacgaccgugguggucgacgagcacugcggcaaccgcgggccgucccugcggaccaccacggugaccggcaagaucauccacgaguggugcugccgcagcugcacccugccgccccugcgguuccgcggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccggugguccaagaagaugcugaugaccggcacgcucgccguguucuuccugcugaucauggggcagcucaccuggaacgaccugauccgccugugcaucauggugggcgccaacgcgagcgaccgcauggggaugggcaccaccuaccucgcccugauggccacguucaagaugcggccgauguucgccgucgggcuccucuuccgccggcugaccucccgcgaggugcugcuccugaccaucgggcugagccucguggccuccgucgagcugcccaacagccuggaggagcucggcgacgggcuggcgaugggcaucaugauccugaagcuccugaccgacuuccagucccaccagcugugggccacgcuccugagccugaccuucaucaagaccaccuucucccuccacugcgccuggaagacgauggccaugauccugagcaucgugucccuguucccccucugccugagcaccaccucccagaagaccacguggcugcccguccuccugggcagccuggggugcaagccgcucaccauguuccugaucgcggagaacaagaucuggggccggcgcuccuggccccugaacgaggggaucauggccgugggcaucgugagcauccuccugagcucccugcucaagaacgacgucccccuggccgggccccugaucgccggcggcaugcucaucgccugcuacgugaucagcggguccagcgcggaccugucccuggagaaggccgccgaggugagcugggaggaggaggccgagcacuccggcgccagccacaacauccucgucgaggugcaggacgacgggaccaugaagaucaaggacgaggagcgggacgacacccugaccauccugcucaaggcgacgcugcuggccguguccggcgucuacccgcucagcauccccgccacccuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggaggacguguuccacaccauguggcacgucacgcggggcgccgugcugauguaccaggggaagcgccucgagcccagcugggcguccgugaagaaggaccugaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccucgacuucaagcccgggaccagcggcucccccaucgugaaccgcgaggggaagaucgucggccuguacggcaacgggguggugaccaccagcggcacguacgucagcgcgaucgcccaggccaaggccucccaggaggggccgcugcccgagaucgaggacgagguguuccggaagcgcaaccucaccaucauggaccugcaccccggcagcgggaagacccggcgcuaccugccggcgaucgugcgggaggccaucaagcgcaagcuccgcacccugauccuggcccccacgcgggucguggccuccgagauggccgaggcgcucaagggcaugcccauccgcuaccagaccaccgccgucaagagcgagcacaccggcaaggagaucgucgaccugaugugccacgccacguucaccaugcggcugcucucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccucaagcccgucauccugaaggacgggcccgagcgcgugauccuggccggccccaugccggugaccgucgccuccgccgcccagcggcgcgggcggaucggccgcaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccggcugcgcggcgaggcgcggaagacguucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccgcagcaccugacccagcgcgcccagaacgcccuggacaaccucgugaugcugcacaacagcgagcagggcgggcgggccuaccgccacgcgauggaggagcugcccgacacgaucgagacccucaugcugcuggcccucaucgccguccugaccggcggggugacccuguucuuccucuccggccgggggcugggcaagaccagcaucggccugcucugcgugauggccuccagcguccugcuguggauggccuccguggagccccacuggaucgcggccagcaucauccucgaguucuuccugauggugcugcucauccccgagccggaccgccagcggacgccccaggacaaccagcuggccuacgucgugaucgggcuccucuucaugauccugaccguggccgccaacgagaugggccugcucgagaccaccaagaaggaccuggggaucggccacgucgcgguggagaaccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucauggggcuggacaagggcuggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgcgaggcgcagaagcggaccgccgccggcaucaugaagaaccccacgguggacgggaucgucgccaucgaccuggaccccgugguguacgacgccaaguucgagaagcagcugggccagaucaugcuccugauccugugcaccucccagauccuccugaugcgcaccaccugggcgcugugcgagagcaucacgcucgccaccggcccccugaccacccugugggagggguccccgggcaaguucuggaacacgaccaucgccgucagcauggccaacaucuuccggggguccuaccucgccggcgcgggccuggccuucagccugaugaagucccucgggggcgggcgccggggcaccggggcccagggcgagacccugggcgagaaguggaagcgccagcugaaccagcucuccaagagcgaguucaacacguacaagcgguccgggaucauggagguggaccgcagcgaggccaaggagggccugaagcgcggggagaccaccaagcacgcggugucccgcggcaccgccaagcugcggugguucgucgagcgcaaccuggugaagcccgaggggaaggugaucgaccucggcugcggccgcggcggguggagcuacuacugcgccgggcugaagaaggucacggaggugaagggguacaccaagggcgggcccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccgcacccuccgggugcugaagaugguggagcccuggcugcgcgggaaccaguucugcaucaagauccucaaccccuacaugcccagcgucguggagacccuggagcagaugcagcggaagcacggcggcaugcuggugcgcaacccgcucucccggaacagcacccacgagauguacugggucuccugcgggaccggcaacaucgugagcgccgugaacaugacgucccgcaugcugcugaaccgcuucaccauggcgcaccggaagcccaccuacgagcgcgacgucgaccucggggccggcacccggcacguggccguggagcccgaggucgccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggugaacggggucgugaagcugcucaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgccaaguggcuguggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagccggagcacgcccugcucgcgaaguccaucuucaagcugaccuaccagaacaaggucgugcgcgugcagcggcccgccaagaacgggaccgucauggacgugaucagccgccgggaccagcgcggcuccggccaggugggcacguacggccugaacaccuucaccaacauggaggcccagcucauccggcagauggagagcgaggggaucuucucccccagcgagcuggagacccccaaccuggccgagcgcguccucgacuggcuggagaaguacggcguggagcggcugaagcgcauggccaucuccggggacgacugcguggucaagccgaucgacgaccgguucgcgacggcccucaccgcccugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggagccugcgggagaccgcgugccuggggaaguccuacgcccagauguggcagcucauguacuuccaccgccgggaccugcgccuggccgccaacgcgaucugcagcgccgugcccguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugccguaccuggggaagcgcgaggaccaguggugcggcagccugaucggccucaccgcccgggccaccugggcgaccaacauccaggucgccaucaaccaggugcgccggcugaucgggaacgagaacuaccuggacuacaugaccuccaugaagcgcuucaagaacgagagcgaccccgagggcgcccucugguga

SEQ ID NO: 8833 - RNA, 9879 nt, Artificial Sequence
  derived and/or modified CDS sequence (opt1) from DENV-1__JQ045657__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccaccacccgccuggagaacaucauguggaagcagaucagcaacgagcugaaccacauccuccuggagaacgacaugaaguucaccgugguggucggggacguggccggcauccuggcgcaggggaagaagaugauccggccccagcccauggaguacaaguacuccuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcucaagcugcgggacuccuacacccaggugugcgaccaccgccugaugagcgcggccaucaaggacuccaaggccgugcacgccgacaugggcuacuggaucgagagcgagaagaacgagaccuggaagcucgcccgggcguccuucaucgaggucaagaccugcaucuggcccaagagccacacgcugugguccaacggcgugcuggagagcgagaugaucauccccaagaucuacgggggcccgaucucccagcacaacuaccgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucacguggaacgaccugauccggcugugcaucauggucggcgccaacgcguccgaccgcauggggaugggcaccaccuaccucgcccugauggccaccuucaagaugcgcccgauguucgccgugggccuccuguuccggcgccugacgagccgggaggugcugcuccugaccaucgggcugucccucgucgccagcguggagcugcccaacucccuggaggagcucggcgacgggcuggcgaugggcaucaugauccugaagcuccugaccgacuuccagagccaccagcugugggccacccuccugucccugacguucaucaagaccaccuucagccuccacuacgccuggaagaccauggccaugguccuguccaucgugagccuguucccccucugccuguccacgaccagccagaagaccaccuggcugcccgugcuccugggcucccuggggugcaagccgcucacgauguuccugaucgcggagaacaagaucuggggccgcaagagcuggccccugaacgaggggaucauggccgucggcaucgugagcauccuccuguccagccugcucaagaacgacgugccccuggccgggccccugaucgccggcggcaugcucaucgccugcuacgucaucuccgggagcuccgcggaccugagccuggagaaggccgccgagguguccugggaggaggaggccgagcacagcggcgccucccacaacauccucguggagguccaggacgacgggaccaugaagaucaaggacgaggagcgggacgacacccugaccauccugcucaaggcgacccugcuggccgugagcggcguguacccgcucuccauccccgccacgcuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgccguccugauguaccaggggaagcgccucgagcccuccugggcgagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagaccuccgagggcgaggucggcgccaucgcccucgacuucaagcccgggacgagcggcagccccaucgugaaccgcgaggggaagaucgugggccuguacggcaacggggucgugaccaccuccggcaccuacgugagcgcgaucgcccaggccaaggccucccaggaggggccccugccggagaucgaggacgaggucuuccggaagcgcaaccucacgaucauggaccugcaccccggcagcgggaagacccggcgcuaccugcccgcgaucgugcgggaggccaucaagcgcaagcuccggacccugauccuggccccgacccgcguggucgccuccgagauggccgaggcgcucaagggcaugcccauccgcuaccagacgaccgccgucaagagcgagcacaccggcaaggagaucguggaccugaugugccacgccaccuucacgaugcggcugcucucccccguccgcgugcccaacuacaacaugaucaucauggacgaggcccacuucaccgacccgagcuccaucgccgcgcggggguacaucagcacccgcgugggcaugggggaggccgccgccaucuucaugaccgccacgccgcccggcuccgucgaggcguucccccagagcaacgccgugauccaggacgaggagcgggacaucccggagcgcuccuggaacagcggguacgaguggaucaccgacuuccccggcaagaccgugugguucguccccuccaucaagagcggcaacgacaucgccaacugccugcggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccccgccggugccucaagccggugauccugaaggacgggcccgagcgcgucauccuggccggccccaugcccgugacggucgccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgggagaaguccgccgccaucgacggggaguaccgccugcgcggcgaggcgcggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacuccgacccccuggcccuccgggaguucaaggaguucgccgcgggccgccggagcgucuccggggaccugauccuggagaucggcaagcucccccagcaccugacccagcgcgcccagaacgcccuggacaaccucgugaugcugcacaacagcgagcagggcgggcgggccuaccgccacgcgauggaggagcugccggacaccaucgagacgcucaugcugcuggcccucaucgccgugcugaccggcggggucacccuguucuuccucuccggccgggggcugggcaagaccagcaucggccugcucugcgugauggccuccagcgugcugcuguggauggccuccgucgagccccacuggaucgcggccagcaucauccucgaguucuuccugauggugcugcucauccccgagcccgaccgccagcggaccccgcaggacaaccagcuggccuacguggucaucgggcuccucuucaugauccugacgguggccgccaacgagaugggccugcucgagaccaccaagaaggaccuggggaucggccacguggcggccgagaaccaccaccacgccgccaugcuggacgucgaccuccaccccgccuccgcguggacccuguacgccguggccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggucaacccccugacccucacggcggccgugcugaugcugguggcccacuacgccaucaucggccccgggcuccaggccaaggcgacccgggaggcccagaagcgcaccgccgccggcaucaugaagaacccgaccgucgacgggaucguggccaucgaccuggaccccguggucuacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgugagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagacgaccaagcacgccgucucccgcggcaccgccaagcugcggugguucguggagcgcaaccucgugaagccggaggggaaggucaucgaccugggcugcggccgcggcggguggagcuacuacugcgccgggcugaagaaggugaccgaggugaagggguacacgaagggcgggcccggccacgaggagcccauccccauggccaccuacggguggaaccuggucaagcuccacuccggcaaggacguguucuucgugccgcccgagaagugcgacacccugcugugcgacaucggggagagcucccccaaccccaccaucgaggagggccgcacgcuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucacgauggcccaccgcaagccgaccuacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagacgugggcguaccacggguccuacgaggucaagcccagcggcagcgccuccagcauggugaacggggucgugaagcugcucaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucaccgaggacgaccugcagaacgaggcccgcaucacggacaucauggagcccgagcacgcgcugcucgccaaguccaucuucaagcugaccuaccagaacaaggugguccgggugcagcgcccggccaagaacgggaccgugauggacgucaucagccgccgggaccagcgcggcuccggccaggugggcaccuacggccugaacacguucaccaacauggaggcccagcucauccggcagauggagagcgaggagaucuucucccccagcgagcuggagacccccaaccuggccgggcgcgugcucgacuggcuggagaagcacggcgucgagcggcugaagcgcauggcgaucuccggggacgacugcguggugaagcccaucgacgaccgguucgccaccgcccucacggcccugaacgacaugggcaagguccgcaaggacaucccgcagugggagcccagcaagggguggaacgacuggcagcagguccccuucugcagccaccacuuccaccagcugaucaugaaggacggccgggagaucgugguccccugccgcaaccaggacgagcucgugggccgggcccgcgugucccagggggcgggcuggagccugcgggagaccgccugccuggggaaguccuacgcccagauguggcagcucauguacuuccaccgccgggaccugcgccuggccgcgaacgccaucugcagcgccgucccgguggacugggugcccaccucccggaccacguggagcauccacgcccaccaccaguggaugaccaccgaggacaugcucuccgucuggaaccgcguguggaucgaggagaaccccuggauggaggacaagacccacaucagcuccuggggcgacgugcccuaccuggggaagcgggaggaccaguggugcggcagccugaucggccucacggcccgcgcgaccugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8834 - RNA, 9879 nt, Artificial Sequence
  derived and/or modified CDS sequence (opt1) from DENV-1__JQ045659__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcggguggagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggccacccagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcguguucaccagcguggggaagcugguccaccagaucuucggcaccgccuacgggguccucuucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucacggucguggugggggacgucaccggcauccucgcgcaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacagccacacccaggucugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaucuggcccaagucccacacccuguggagcaacggcguccucgaguccgagaugaucauccccaagaucuacgggggcccgaucagccagcacaacuaccgccccggguacuucacccagacggccggccccuggcaccuggggaagcuggagcucgacuucgaccugugcgagggcaccaccguggccguggacgagcacugcggcaaccgggggccgucccugcgcaccacgaccgucaccggcaagaucauccacgaguggugcugccggagcugcacccugccgccccuccgcuuccgcggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugacgggcacccuggccgucuucuuccugcucaucauggggcagcugaccuggaacgaccugauccgccucugcaucauggugggcgcgaacgccagcgaccgcauggggaugggcaccacguaccuggcccugauggccaccuucaagaugcggccgauguucgccguggggcuccuguuccgccggcugaccucccgcgagguccuccugcugaccaucgggcucagccugguggcguccauggagcugcccaacagccucgaggagcugggcgacgggcuggccaugggcaucaugauccucaagcugcugacggacuuccagucccaccagcucugggccacccugcugagccucaccuucaucaagaccacguucucccugcacuacgccuggaagaccauggcgauggugcugagcaucgucucccucuucccccugugccugagcaccaccucccagaagacgaccuggcuccccgugcugcugggcagccucgggugcaagccgcugaccauguuccugaucgccgagaacaagaucuggggccggcgcuccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggagaaggaggccgagcacuccggcgcgagccacaacauccugguggagguccaggacgacgggaccaugaagaucaaggacgaggagcgggacgacacccugacgauccuccugaaggccacccugcucgccguguccggcguguacccgcugagcauccccgccacccuguucgucugguacuucuggcagaagaagaagcagcgcuccggggugcucugggacacccccagcccgcccgaggugggccgggccguccuggacgacggcaucuaccgcaucaugcagcgggggcugcugggccgcucccaggugggggugggcgucuuccaggagaacguguuccacacgauguggcacgugacccgcggggccguccucauguaccagggcaagcggcuggagcccagcugggccuccgugaagaaggaccugaucagcuacggcgggggcuggcggcuccagggguccuggaacaccggcgaggaggugcaggucaucgccguggagcccgggaagaaccccaagaacgugcagaccgcccccggcacguucaagacccccgagggcgaggucggggccaucgcgcuggacuucaagcccggcaccagcgggucccccaucgugaaccgcgagggcaagaucgugggccuguacgggaacggcgucgugaccacgagcgggaccuacgugagcgccaucgcccaggccaaggcgucccaggagggcccgcuccccgagaucgaggacgaggucuuccggaagcgcaaccugaccaucauggaccugcaccccgggagcggcaagacccggcgcuaccucccggccaucgugcgggaggccaucaagcgcaagcugcgcacgcugauccucgcccccacccggguggucgccuccgagauggcggaggcccugaagggcaugcccauccgcuaccagaccaccgccgucaagagcgagcacacggggaaggagaucguggaccugaugugccacgccaccuucaccaugcggcuccugucccccguccgcgugccgaacuacaacaugaucaucauggacgaggcccacuucaccgaccccagcuccaucgcggcccggggcuacaucagcacgcgcguggggaugggcgaggccgccgccaucuucaugaccgcgacgccgcccggguccgucgaggccuucccgcagagcaacgccgugauccaggacgaggagcgggacauccccgagcgcuccuggaacagcggcuacgaguggaucaccgacuuccccggcaagacggugugguucguccccuccaucaagagcgggaacgacaucgccaacugccugcggaagaacggcaagcgcgugauccagcucucccggaagaccuucgacaccgaguaccagaagaccaagaacaacgacugggacuacguggucacgaccgacaucagcgagaugggggcgaacuuccgcgccgaccgggugaucgacccgcgccggugccugaagcccgugauccugaaggacggccccgagcgcgucauccucgccgggcccaugccggugaccguggccuccgccgcgcagcggcgcggccggaucggccgcaaccacaacaaggagggggaccaguacaucuacaugggccagccccugaacaacgacgaggaccacgcccacuggaccgaggccaagaugcugcucgacaacaucaacacgcccgaggggaucauccccgcccuguucgagccggagcgcgagaaguccgccgcgaucgacggcgaguaccggcugcgcggggaggcccggaagaccuucgucgagcucaugcgccggggcgaccugcccguguggcuguccuacaaggucgccagcgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccccucgcccugcgggaguucaaggaguucgcggccgggcgccggagcgucuccggcgaccugauccucgagaucggcaagcugccgcagcaccugacgcagcgcgcccagaacgcccucgacaaccuggugaugcugcacaacagcgagcagggcgggcgggcguaccgccacgccauggaggagcuccccgacaccaucgagacccugaugcugcucgcccugaucgccgugcugaccgggggcgucacccucuucuuccuguccgggcggggccugggcaagacgagcaucgggcuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugaccguggccgcgaacgagauggggcuccuggagaccacgaagaaggaccugggcaucgggcacguggccgucgagaaccaccaccacgccgccaugcucgacguggaccugcaccccgccuccgcguggacccuguacgccguggccaccaccaucaucacgccgaugaugcgccacaccaucgagaacaccaccgccaacaucagccucacggccaucgcgaaccaggccgccauccugaugggccuggacaagggcuggcccaucuccaagauggacaucggggucccccuccuggcccugggcugcuacagccaggugaacccccucacccugaccgcggccgugcugaugcucgucgcccacuacgccaucaucgggccgggccugcaggccaaggcgacccgcgaggcccagaagcggacggccgccgggaucaugaagaaccccaccguggacggcaucguggccaucgaccuggaccccgucguguacgacgcgaaguucgagaagcagcucggccagaucaugcugcugauccucugcaccucccagauccugcugaugcgcaccacgugggcccucugcgagagcaucacccuggccaccgggccccugaccacgcucugggagggcuccccggggaaguucuggaacaccaccaucgccgugagcauggccaacaucuuccggggcuccuaccuggcgggcgccgggcuggccuucagccucaugaagucccugggcgggggccgccgggggaccggcgcccagggcgagacgcugggggagaaguggaagcgccagcucaaccagcuguccaagagcgaguucaacaccuacaagcgguccggcaucauggaggucgaccgcagcgaggcgaaggaggggcugaagcggggcgagaccaccaagcacgccgugucccgcgggacggccaagcuccggugguucguggagcgcaaccuggucaagcccgagggcaaggugaucgaccugggcugcgggcggggcggguggagcuacuacugcgccggccugaagaaggugaccgaggucaagggguacaccaagggcggccccgggcacgaggagcccaucccgauggccaccuacggcuggaaccucgugaagcugcacuccgggaaggacguguucuucaucccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcacggggaacaucgucagcgcggugaacaugaccucccgcaugcugcucaaccgcuucaccauggcccaccggaagcccaccuacgagcgcgacguggaccugggcgccggcacgcggcacgucgccguggagcccgagguggccaaccuggacaucaucgggcagcgcaucgagaacaucaagcacgagcacaagagcaccuggcacuacgacgaggacaaccccuacaagaccugggcguaccacggcuccuacgaggucaagccgagcggguccgccagcagcauggugaacggcguggucaagcuccugaccaagcccugggacgugauccccauggucacgcagaucgccaugaccgacaccacccccuucgggcagcagcggguguucaaggagaagguggacacgcgcaccccgaaggccaagcggggcaccgcccagaucauggaggucaccgcgaaguggcuguggggcuuccucucccgcaacaagcggccccgcaucugcacgcgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacaccgccgggugggacacgcgcaucaccgaggacgaccugcagaacgaggcccgcaucaccgacaucauggagccggagcacgcgcuccuggccaaguccaucuucaagcugaccuaccagaacaaggugguccgggugcagcgccccgccaagaacggcacggugauggacgucaucagccggcgcgaccagcggggguccggccaggugggcaccuacgggcucaacaccuucaccaacauggaggcccagcugauccgccagauggagagcgagggcaucuucucccccagcgagcuggagacgcccaaccucgccgagcgggugcuggacuggcuggagaaguacggggucgagcgccucaagcggauggcgaucuccggcgacgacugcguggugaagccgaucgacgaccgcuucgccaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgcgggguggagccugcgcgagaccgccugccucggcaaguccuacgcccagauguggcagcugauguacuuccaccggcgcgaccugcggcucgccgcgaacgccaucugcagcgccguccccguggacuggauccccacgucccgcaccaccuggagcauccacgcccaccaccaguggaugaccacggaggacaugcuguccguguggaaccgcgucuggaucgaggagaaccccuggauggaggacaagacccacaucagcuccuggggcgacgugccguaccugggcaagcgggaggaccaguggugcggcagccucaucgggcugaccgcccgcgcgaccugggccaccaacauccagguggccaucaaccagguccggcgccugaucggcaacgagaacuaccucgacuacaugacguccaugaagcgguucaagaacgagagcgaccccgagggggcccugugguga

SEQ ID NO: 8835 - RNA, 9879 nt, Artificial Sequence
  derived and/or modified CDS sequence (opt1) from DENV-1__JQ045661__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgucgccggcauccuggcgcaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaccuggcccaagucccacacccucuggagcaacggcguccuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgugguggucgacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugacgggcacccuggccguguucuuccuccugaucguggggcagcugaccuggaacgaccucauccgccugugcaucaugaucggcgccaacgcgagcgaccgcauggggaugggcaccacguaccuggcccucauggccaccuucaagaugcggccgauguucgccgucggccugcuguuccgccggcucaccucccgcgaggugcugcugcucaccaucgggcugagccugguggccuccgucgagcuccccaacagccuggaggagcugggcgacgggcucgcgaugggcaucaugauccugaagcugcucacggacuuccagucccaccagcugugggccacccugcucagccugaccuucaucaagaccacguucucccugcacuacgccuggaagaccauggccauggugcucagcgucgugucccuguucccccugugccucagcaccaccucccagaagacgaccuggcugcccgugcugcucggcagccuggggugcaagccgcugaccauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucacgauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacacgauguggcacgugacccggggcgccguccugauguaccaggggaagcgccuggagcccagcugggcguccgugaagaaggaccucaucagcuacggcggcggguggcggcugcagggcuccuggaacaccggggaggaggugcaggucaucgccguggagcccggcaagaaccccaagaacgugcagaccgcccccgggacguucaagacccccgagggcgaggucggcgccaucgcccuggacuucaagcccgggaccagcggcucccccaucgugaaccgcgaggggaagaucgugggccucuacggcaacggggucgugaccacgagcggcaccuacgugagcgcgaucgcccaggccaaggccucccaggaggggccgcugcccgagaucgaggacgaggucuuccggaagcgcaaccugaccaucauggaccuccaccccggcagcgggaagacccggcgcuaccugccggcgaucgugcgggaggccaucaagcgcaagcugcgcacgcucauccuggcccccacccggguggucgccuccgagauggccgaggcgcugaagggcaugcccauccgcuaccagaccaccgccgucaagagcgagcacacgggcaaggagaucguggaccucaugugccacgccaccuucaccaugcggcugcugucccccguccgcgugccgaacuacaacaugaucaucauggacgaggcccacuucaccgaccccagcuccaucgccgcgcggggguacaucagcacgcgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagacggugugguucguccccuccaucaagagcggcaacgacaucgccaacugccuccggaagaacgggaagcgcgugauccagcugucccggaagaccuucgacaccgaguaccagaagaccaagaacaacgacugggacuacguggucacgaccgacaucagcgagaugggcgccaacuuccgcgcggaccgggugaucgacccgcgccggugccugaagcccgugauccucaaggacgggcccgagcgcgucauccuggccggccccaugccggugaccgucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacgcccgagggcaucauccccgcccuguucgagccggagcgcgagaaguccgccgccaucgacggggaguaccggcuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacgcagcgcgcccagaacgcccuggacaaccuggugaugcuccacaacagcgagcagggcgggcgggccuaccgccacgcgauggaggagcugcccgacaccaucgagacccugaugcuccuggcccugaucgccgugcucaccggcggggucacccuguucuuccuguccggccgggggcucggcaagacgagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccacgaagaaggaccucgggaucggccacguggcggucgagaaccaccaccacgccgccaugcuggacguggaccugcaccccgccuccgccuggacccucuacgcgguggccaccaccaucaucacgccgaugaugcgccacaccaucgagaacaccaccgccaacaucagccugacggccaucgccaaccaggcggccauccugauggggcucgacaagggcuggcccaucuccaagauggacaucggcgucccccugcuggcccucgggugcuacagccaggugaacccccugacccugaccgccgcggugcucaugcuggucgcccacuacgccaucaucggcccggggcugcaggccaaggccacccgcgaggcgcagaagcggacggccgccggcaucaugaagaaccccaccguggacgggaucguggccaucgaccucgaccccgucguguacgacgccaaguucgagaagcagcugggccagaucaugcugcucauccugugcaccucccagauccugcucaugcgcaccacgugggcgcugugcgagagcaucacccuggccaccggcccccucaccacgcugugggagggguccccgggcaaguucuggaacaccaccaucgccgugagcauggccaacaucuuccggggguccuaccuggccggcgcgggccucgccuucagccugaugaagucccucgggggcgggcgccgggggaccggggcccagggcgagacgcucggcgagaaguggaagcgccagcugaaccagcuguccaagagcgaguucaacaccuacaagcgguccgggaucauggaggucgaccgcagcgaggccaaggagggccucaagcgcggggagaccaccaaguacgcggugucccgcggcacggccaagcugcggugguucguggagcgcaaccuggucaagcccgaggggaaggugaucgaccugggcugcggccgcgggggcuggagcuacuacugcgccgggcucaagaaggugaccgaggucaagggcuacaccaagggcggccccggccacgaggagcccaucccgauggccaccuacggguggaaccuggugaagcugcacuccggcaaggacguguucuucaucccgcccgagaagugcgacacgcuccugugcgacaucggggagagcucccccaacccgaccaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggacgggcaacaucgucagcgccgugaacaugaccucccgcaugcuccugaaccgcuucaccauggcgcaccggaagcccaccuacgagcgcgacguggaccugggggccggcacgcggcacgucgccguggagcccgagguggccaaccucgacaucaucggccagcgcaucgagaacaucaagcacgagcacaagagcaccuggcacuacgacgaggacaaccccuacaagaccugggccuaccacggguccuacgaggucaagccgagcggcuccgcgagcagcauggugaacggggucgugaagcugcugaccaagcccugggacgugauccccauggucacgcagaucgccaugaccgacaccacccccuucggccagcagcggguguucaaggagaagguggacacgcgcaccccgaaggccaagcgggggaccgcccagaucauggaggucaccgccaaguggcucuggggcuuccugucccgcaacaagaagccccggaucugcacgcgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggcccgcaucaccgacaucauggagccggagcacgcccugcuggcgaaguccaucuucaagcucaccuaccagaacaaggugguccgcgugcagcggcccgccaagaacgggacggugauggacgucaucagccgccgggaccagcgcggcuccggccagguggggaccuacggccugaacaccuucaccaacauggaggcccagcugauccggcagauggagagcgaggggaucuucucccccagcgagcucgagacgcccaaccuggccgagcgcgugcuggacuggcucgagaaguacggcgucgagcggcugaagcgcauggccaucuccggggacgacugcguggugaagccgaucgacgaccgguucgcgaccgcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcccgcgugagccagggggccggcuggagccuccgggagaccgcgugccuggggaaguccuacgcccagauguggcagcugauguacuuccaccgccgggaccuccgccuggccgccaacgcgaucugcagcgccguccccguggacuggauccccacgucccggaccaccuggagcauccacgcccaccaccaguggaugaccacggaggacaugcuguccguguggaaccgcgucuggaucgaggagaaccccuggauggaggacaagacccacaucagcuccuggggcgacgugccguaccucgggaagcgcgaggaccaguggugcggcagccugaucggccugaccgcccgggccaccugggcgaccaacauccagguggccaucaaccagguccgccggcucaucgggaacgagaacuaccuggacuacaugacguccaugaagcgcuucaagaacgagagcgaccccgagggcgcccugugguga

SEQ ID NO: 8836 - RNA, 9879 nt, Artificial Sequence
  derived and/or modified CDS sequence (opt1) from DENV-1__JQ045663__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccgcuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagcuggccgagacccagcacggcaccgugcuggugcagaucaaguacgagggcaccgacgcgcccugcaagauccccuucagcacgcaggacgagaagggggucacccagaacggccggcugaucaccgccaacccgaucgugaccgacaaggagaagcccgugaacaucgaggccgagccgcccuucggggaguccuacaucgucaucggcgccggcgagaaggcgcucaagcugagcugguucaagaagggguccagcaucggcaagauguucgaggccacggcccgcggggcccggcgcauggccauccugggcgacaccgcgugggacuucggguccaucggcggcguguucaccagcguggggaagcucguccaccagaucuucggcaccgccuacggggugcuguucuccggcgugagcuggacgaugaagaucgggaucggcguccugcucaccuggcugggccugaacucccgcagcaccucccucagcaugaccugcaucgccguggggcuggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaagcugacggucguggugggggacgucgccggcauccuggcgcaggggaagaagaugauccggccccagcccauggaguacaaguacagcuggaaguccuggggcaaggccaagaucaucggcgccgacgugcagaacaccaccuucaucaucgacgggcccagcaccccggagugccccgacgaccagcgcgccuggaacaucugggagguggaggacuacggcuucgggaucuucacgaccaacaucuggcucaagcugcgggacucccacacccaggucugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaucuggcccaagagccacacccugugguccaacggcguccuggagagcgagaugaucauccccaagaucuacgggggcccgaucucccagcacaacuaccgccccggguacuucacccagaccgccggccccuggcaccucgggaagcuggagcuggacuucgaccucugcgagggcacgaccgugguggucgacgagcacugcggcaaccgggggccgagccugcgcaccaccacggugaccggcaagaucauccacgaguggugcugccgguccugcacccugccgccccugcgcuuccgcggggaggacggcugcugguacgggauggagauccgccccgugaaggagaaggaggagaaccuggucaagagcauggugagcgccggcuccggcgagguggacagcuucucccuggggcuccugugcaucagcaucaugaucgaggaggucaugcggucccgcuggagccggaagaugcugaugaccggcacgcucgccguguucuuccugcugaucauggggcagcucaccuggaacgaccugauccgccugugcaucauggugggcgccaacgcguccgaccgcauggggaugggcaccaccuaccucgcccugauggccacguucaagaugcggccgauguucgccgucggccuccuguuccgccggcugaccagccgcgaggugcugcuccugaccaucgggcugucccucguggccagcgucgagcugcccaacucccuggaggagcucggcgacgggcuggcgaugggcaucaugauccugaagcuccugaccgacuuccagagccaccagcugugggccacgcuccugucccugaccuucaucaagaccaccuucagccuccacuacgccuggaagacgauggccauggugcuguccaucgucagccuguucccccucugccuguccaccaccagccagaagaccacguggcugcccgugcuccugggcucccuggggugcaagccgcucaccauguuccugaucgcggagaacaagaucuggggccggcgcagcuggccccugaacgaggggaucauggccgugggcaucgucagcauccuccuguccagccugcucaagaacgacgugccccuggccgggccccugaucgccggcggcaugcucaucgccugcuacgugaucuccgggagcuccgcggaccugagccuggagaaggccgccgaggucuccugggaggaggaggccgagcacagcggcgccucccacaacauccucguggaggugcaggacgacgggaccaugaagaucaaggacgaggagcgggacgacacccugaccauccugcucaaggcgacgcugcuggccgucagcggcguguacccgcucuccauccccgccacccuguucgugugguacuucuggcagaagaagaagcagcgcagcgggguccugugggacacccccagcccgcccgagguggagcgggccgugcuggacgacggcaucuaccgcaucaugcagcggggccuccuggggcgcagccaggucggcguggggguguuccaggagaacgucuuccacaccauguggcacgugacgcggggcgccgugcugauguaccaggggaagcgccucgagcccuccugggcgagcgucaagaaggaccugaucuccuacggcggcggguggcggcugcagggcagcuggaacaccggggaggagguccaggugaucgccgucgagcccggcaagaacuccaagaacgugcagaccgcccccgggaccuucaagacgcccgagggcgaggugggcgccaucgcccucgacuucaagcccgggaccagcggcagccccaucgucaaccgcgaggggaagaucgugggccuguacggcaacgggguggucaccaccuccggcacguacgugagcgcgaucgcccaggccaaggccucccaggaggggccccugccggagaucgaggacgagguguuccggaagcgcaaccucaccaucauggaccugcaccccggcagcgggaagacccggcgcuaccugcccgcgaucguccgggaggccaucaagcgcaagcuccgcacccugauccuggccccgacgcgggugguggccuccgagauggccgaggcgcucaagggcaugcccauccgcuaccagaccaccgccgucaagagcgagcacaccggcaaggagaucguggaccugaugugccacgccacguucaccaugcggcugcucucccccgugcgcguccccaacuacaacaugaucaucauggacgaggcccacuucaccgacccgagcuccaucgccgcgcggggguacaucagcacccgcgugggcaugggggaggccgccgccaucuucaugacggccacgccgcccggcuccguggaggcguucccccagagcaacgccgucauccaggacgaggagcgggacaucccggagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagacguucgacaccgaguaccagaagaccaagaacaacgacugggacuacguggugaccacggacaucagcgagaugggcgccaacuuccgcgcggaccgggucaucgacccccgccggugccucaagccggugauccugaaggacgggcccgagcgcgugauccuggccggccccaugcccgucaccguggccuccgccgcccagcggcgcgggcggaucggccgcaaccacaacaaggagggcgaccaguacaucuacauggggcagccgcucaacaacgacgaggaccacgcgcacuggaccgaggccaagaugcugcuggacaacaucaacacccccgagggcaucauccccgcccucuucgagcccgagcgcgagaaguccgccgccaucgacggggaguaccggcugcgcggcgaggcgcggaagacguucgucgagcugaugcgccgcggggaccucccgguguggcugagcuacaagguggccuccgagggcuuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccccuggcccuccgggaguucaaggaguucgccgcgggccgccggagcguguccggggaccugauccuggagaucggcaagcucccccagcaccugacccagcgcgcccagaacgcccuggacaaccucgucaugcugcacaacagcgagcagggcgggcgggccuaccgccacgcgauggaggagcugccggacacgaucgagacccucaugcugcuggcccucaucgccgugcugaccggcggggugacccuguuccuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagcccgaccgccagcggacgccgcaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucacccccaugaugcgccacacgaucgagaacaccaccgccaacaucagccucaccgccaucgccaaccaggcggccauccugauggggcuggacaagggcuggccgaucuccaagauggacaucggcgugccccuccuggcccuggggugcuacagccaggucaacccccucacgcugaccgccgcggugcugaugcucguggcccacuacgccaucaucggccccgggcugcaggccaaggccacccgcgaggcgcagaagcggaccgccgccggcaucaugaagaacccgacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggaggggucccccggcaaguucuggaacacgaccaucgccgugagcauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcugcggugguucguggagcgcaaccucgugaagccggaggggaaggucaucgaccugggcugcggccgcgggggcuggagcuacuacugcgccgggcugaagaaggugacggaggugaagggcuacaccaagggcggccccggccacgaggagcccauccccauggccaccuacggguggaaccucgucaagcugcacuccggcaaggacguguucuucaucccgcccgagaagugcgacacccugcucugcgacaucggggagagcucccccaaccccacgaucgaggagggccgcacccugcgggugcugaagauggucgagccguggcuccgcgggaaccaguucugcaucaagauccugaaccccuacaugcccagcgugguggagacccuggagcagaugcagcggaagcacggcggcaugcucguccgcaacccccugucccggaacagcacccacgagauguacuggguguccugcgggaccggcaacaucgugagcgccgucaacaugacgucccgcaugcugcucaaccgcuucaccauggcgcaccggaagccgaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagcccagcggcagcgcguccagcauggucaacgggguggucaagcuccugaccaagccgugggacgugauccccauggugacccagaucgccaugacggacaccacccccuucggccagcagcgggucuucaaggagaagguggacacccgcacgcccaaggccaagcgggggaccgcccagaucauggaggugaccgccaaguggcuguggggcuuccucucccgcaacaagaagccgcggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagcccgagcacgcccuccuggcgaaguccaucuucaagcugaccuaccagaacaagguggugcgcguccagcggccggccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcuggagaaguacggcguggagcggcucaagcgcauggccaucuccggggacgacugcgucgugaagcccaucgacgaccgguucgcgacggcccugaccgcccugaacgacaugggcaaggugcgcaaggacaucccgcagugggagcccagcaagggguggaacgacuggcagcagguccccuucugcagccaccacuuccaccagcucaucaugaaggacggccgggagaucguggugcccugccgcaaccaggacgagcuggucggccgggcccgcgugucccagggggccggcuggagccugcgggagaccgcgugccucgggaaguccuacgcccagauguggcagcugauguacuuccaccgccgggaccugcgccucgccgccaacgcgaucugcagcgccgugccggucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacguccccuaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagagcgacccggagggcgcccugugguga

SEQ ID NO: 8837 - RNA, 9879 nt, Artificial Sequence
  derived and/or modified CDS sequence (opt1) from DENV-1__JQ045665__SS-prME
agcgugaccaugcugcucaugcugaugcccaccgcccuggccuuccaccucaccgcccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacaccugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggccacgcagaacggccggcugaucaccgccaacccgaucgucaccgacaaggagaagcccgugaacaucgaggcggagccgcccuucggggaguccuacaucgugaucggcgccggcgagaaggcccucaagcugagcugguucaagaagggguccagcaucggcaagauguucgaggccaccgcccgcggggcgcggcgcauggccauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggcggacuccgggugcgugaucaacuggaagggccgggagcugaagugcgggagcggcaucuucgugacgaacgagguccacaccuggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccguggucgugggggacguggccggcauccuggcccaggggaagaagaugauccggccccagcccauggaguacaaguacagcuggaaguccuggggcaaggccaagaucaucggcgcggacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucguggugaacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgccugucccggaagaugcugaugaccggcacccucgcggucuucuuccugcugaucauggggcagcucacguggaacgaccugauccgccugugcaucauggugggcgccaacgccagcgaccgcauggggaugggcaccaccuaccucgcccugauggccaccuucaagaugcggccgauguucgcggugggccuccuguuccgccggcugacgucccgcgagguccugcuccugaccaucgggcugagccucguggccuccguggagcugcccaacagccuggaggagcucggcgacgggcuggccaugggcaucaugauccugaagcuccugaccgacuuccagucccaccagcugugggccacccuccugagccugacguucaucaagaccaccuucucccuccaccacgcguggaagaccauggccaugauccugagcaucgucucccuguucccccucugccugagcacgaccucccagaagaccaccuggcugcccgugcuccugggcagccuggggugcaagccgcucacgauguuccugaucgccgagaacaagaucuggggccggcgcuccuggccccugaacgaggggaucauggccgucggcaucgugagcauccuccugagcucccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggaccaugaagaucaaggacgaggagcgggacgacacccugaccauccugcucaaggccacccugcuggccguguccggcguguacccgcucagcauccccgccacgcuguucgucugguacuucuggcagaagaagaagcagcgcuccggggugcugugggacacccccagcccgcccgagguggagcgggcgguccuggacgacggcaucuaccgcaucaugcagcggggccuccuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgcgaucgcccucgacuucaagcccgggacgagcggcucccccaucgugaaccgcgaggggaagaucgugggccuguacggcaacggggucgugaccaccagcggcaccuacgugagcgccaucgcccaggcgaaggccucccaggaggggccgcugcccgagaucgaggacgaggucuuccggaagcgcaaccucacgaucauggaccugcaccccggcagcgggaagacccggcgcuaccugccggccaucgugcgggaggccaucaagcgcaagcuccgcacccugauccuggcccccacccggguggucgcguccgagauggccgaggcccucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcgcacuucaccgaccccagcuccaucgccgcccggggguacaucagcacccgcgugggcaugggggaggccgccgcgaucuucaugaccgccacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgcgaacugccugcggaagaacgggaagcgcgugauccagcugucccggaagaccuucgacacggaguaccagaagaccaagaacaacgacugggacuacguggucaccaccgacaucagcgagaugggcgccaacuuccgcgccgaccgggugaucgacccgcgccggugccucaagcccgugauccugaaggacgggcccgagcgcgucauccuggccggccccaugccggugacgguggccuccgcggcccagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgcggccaucgacggggaguaccggcugcgcggcgaggcccggaaguccuucgucgagcugaugcgccgcggggaccuccccguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccgcagcaccugacccagcgcgcccagaacgcgcuggacaaccucgugaugcugcacaacuccgagcagggcgggcgggccuaccgccacgccauggaggagcugcccgacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagccggaccgccagcggacgccccaggacaaccagcuggccuacguggucaucgggcuccuguucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucaccccgaugaugcgccacaccaucgagaacaccacggccaacaucucccugaccgcgaucgccaaccaggccgccauccucauggggcuggacaagggcuggcccaucagcaagauggacaucggcgucccccugcucgcgcuggggugcuacucccaggugaacccccugacccucaccgccgccgugcugaugcuggucgcccacuacgccaucaucggcccggggcuccaggcgaaggccacgcgcgaggcccagaagcggaccgccgccggcaucaugaagaaccccaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagcccgggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccuggucaagcccgaggggaaggugaucgaccucggcugcggccgcggcgggugguccuacuacugcgccgggcugaagaaggugaccgaggucaagggguacaccaagggcgggcccggccacgaggagcccaucccgauggcgacguacggguggaaccuggugaagcuccacagcggcaaggacguguucuucaucccgcccgagaagugcgacacccugcugugcgacaucggggaguccagccccaacccgaccaucgaggagggccgcacccuccggguccugaagaugguggagcccuggcugcgcgggaaccaguucugcaucaagauccucaaccccuacaugcccuccguggucgagacgcuggagcagaugcagcggcgccacggcggcaugcuggugcggaacccgcucagccgcaacuccacccacgagauguacugggugagcugcgggaccggcaacaucgucuccgccgugaacaugaccagccgcaugcugcugaaccgguucaccauggcccaccgcaagcccacguacgagcgggacguggaccucggggccggcacccgccacgucgccguggagcccgagguggcgaaccuggacaucaucggccagcggaucgagaacaucaagcacgagcacaaguccaccuggcacuacgacgaggacaaccccuacaagaccugggccuaccacgggagcuacgaggucaagccguccggcagcgccagcuccauggugaacgggguggucaagcugcucacgaagcccugggacgugauccccauggucacccagaucgccaugaccgacaccacgcccuucggccagcagcgcguguucaaggagaagguggacacccggaccccgaaggccaagcgcgggaccgcgcagaucauggaggucacggccaaguggcuguggggcuuccugagccggaacaagaagccccgcaucugcacccgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgccgacgacacggccggcugggacacccgcaucaccgaggacgaccugcagaacgaggcgcgcaucaccgacaucauggagccggagcacgcccugcucgccaagagcaucuucaagcugacguaccagaacaaggugguccgggugcagcgccccgccaagaacgggaccgugauggacgucaucucccggcgcgaccagcggggcagcggccagguggggaccuacggccugaacaccuucacgaacauggaggcccagcucauccgccagauggaguccgaggggaucuucagccccuccgagcuggagacccccaaccuggcggagcgggugcucgacuggcuggagaaguacggcgucgagcgccugaagcggauggccaucagcggggacgacugcguggugaagccgaucgacgaccgcuucgccaccgcccucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcgcgggugagccagggggccggcuggucccugcgcgagacggccugccugggcaagagcuacgcccagauguggcagcucauguacuuccaccggcgcgaccugcggcuggcggccaacgccaucugcuccgccguccccguggacuggauccccacgaccugcaccacguggagcauccacgcccaccaccaguggaugaccaccgaggacaugcucuccguguggaaccgcgucuggaucgaggagaaccccuggauggaggacaagacccacaucagcuccuggggcgacgugccguaccuggggaagcgcgaggaccaguggugcggcagccugaucggccucacggcgcgggccaccugggccaccaacauccagguggccaucaaccagguccgccggcugaucgggaacgagaacuaccuggacuacaugaccuccaugaagcgcuucaagaacgagagcgaccccgagggcgcccucugguga

SEQ ID NO: 8838 - RNA, 9879 nt, Artificial Sequence
  derived and/or modified CDS sequence (opt1) from DENV-1__JQ045666__SS-prME
agcgugaccaugcugcucaugcugaugcccaccgcccuggccuuccaccucaccgcccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagcuggcggagacgcagcacggcaccgugcuggugcagaucaaguacgagggcaccgacgcccccugcaagauccccuucagcacccaggacgagaagggggccacgcagaacggccggcugaucaccgccaacccgaucgucaccgacaaggagaagcccgugaacaucgaggcggagccgcccuucggggaguccuacaucgugaucggcgccggcgagaaggcccucaagcugagcugguucaagaagggguccagcaucggcaagauguucgaggccaccgcccgcggggcgcggcgcauggccauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggcggacuccgggugcgugaucaacuggaagggccgggagcugaagugcgggagcggcaucuucgugacgaacgagguccacaccuggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccguggucgugggggacguggccggcauccuggcccaggggaagaagaugauccggccccagcccauggaguacaaguacagcuggaaguccuggggcaaggccaagaucaucggcgcggacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucguggugaacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgccugucccggaagaugcugaugaccggcacccucgcggucuucuuccugcugaucauggggcagcucacguggaacgaccugauccgccugugcaucauggugggcgccaacgccagcgaccgcauggggaugggcaccaccuaccucgcccugauggccaccuucaagaugcggccgauguucgcggugggccuccuguuccgccggcugacgucccgcgagguccugcuccugaccaucgggcugagccucguggccuccguggagcugcccaacagccuggaggagcucggcgacgggcuggccaugggcaucaugauccugaagcuccugaccgacuuccagucccaccagcugugggccacccuccugagccugacguucaucaagaccaccuucucccuccaccacgcguggaagaccauggccaugauccugagcaucgucucccuguucccccucugccugagcacgaccucccagaagaccaccuggcugcccgugcuccugggcagccuggggugcaagccgcucacgauguuccugaucgccgagaacaagaucuggggccggcgcuccuggccccugaacgaggggaucauggccgucggcaucgugagcauccuccugagcucccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggaccaugaagaucaaggacgaggagcgggacgacacccugaccauccugcucaaggccacccugcuggccguguccggcguguacccgcucagcauccccgccacgcuguucgucugguacuucuggcagaagaagaagcagcgcuccggggugcugugggacacccccagcccgcccgagguggagcgggcgguccuggacgacggcaucuaccgcaucaugcagcggggccuccuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgcgaucgcccucgacuucaagcccgggacgagcggcucccccaucgugaaccgcgaggggaagaucgugggccuguacggcaacggggucgugaccaccagcggcaccuacgugagcgccaucgcccaggcgaaggccucccaggaggggccgcugcccgagaucgaggacgaggucuuccggaagcgcaaccucacgaucauggaccugcaccccggcagcgggaagacccggcgcuaccugccggccaucgugcgggaggccaucaagcgcaagcuccgcacccugauccuggcccccacccggguggucgcguccgagauggccgaggcccucaagggcaugcccauccgcuaccagacgaccgccgucaagagcgagcacaccggcaaggagaucguggaccugaugugccacgccaccuucacgaugcggcugcucucccccguccgcgugccgaacuacaacaugaucaucauggacgaggcgcacuucaccgaccccagcuccaucgccgcccggggguacaucagcacccgcgugggcaugggggaggccgccgcgaucuucaugaccgccacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgcgaacugccugcggaagaacgggaagcgcgugauccagcugucccggaagaccuucgacacggaguaccagaagaccaagaacaacgacugggacuacguggucaccaccgacaucagcgagaugggcgccaacuuccgcgccgaccgggugaucgacccgcgccggugccucaagcccgugauccugaaggacgggcccgagcgcgucauccuggccggccccaugccggugacgguggccuccgcggcccagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgcggccaucgacggggaguaccggcugcgcggcgaggcccggaaguccuucgucgagcugaugcgccgcggggaccuccccguguggcugagcuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcacguacagcgacccccuggcgcuccgggaguucaaggaguucgccgccggccgccgguccgucagcggggaccugauccuggagaucggcaagcucccgcagcaccugacccagcgcgcccagaacgcgcuggacaaccucgugaugcugcacaacuccgagcagggcgggcgggccuaccgccacgccauggaggagcugcccgacaccaucgagacccucaugcugcuggcccucaucgccgugcugacgggcggggucacccuguucuuccucagcggccgggggcugggcaagaccuccaucggccugcucugcgugauggcgagcuccgugcugcuguggauggccagcgucgagccccacuggaucgccgccuccaucauccucgaguucuuccugauggugcugcucauccccgagccggaccgccagcggacgccccaggacaaccagcuggccuacguggucaucgggcuccuguucaugauccugaccguggcggccaacgagaugggccugcucgagacgaccaagaaggaccuggggaucggccacguggccgucgagaaccaccaccacgccgccaugcuggacguggaccuccaccccgcgagcgccuggacccuguacgccguggccaccacgaucaucaccccgaugaugcgccacaccaucgagaacaccacggccaacaucucccugaccgcgaucgccaaccaggccgccauccucauggggcuggacaagggcuggcccaucagcaagauggacaucggcgucccccugcucgcgcuggggugcuacucccaggugaacccccugacccucaccgccgccgugcugaugcuggucgcccacuacgccaucaucggcccggggcuccaggcgaaggccacgcgcgaggcccagaagcggaccgccgccggcaucaugaagaaccccaccguggacgggaucguggcgaucgaccuggaccccgucguguacgacgccaaguucgagaagcagcugggccagaucaugcuccugauccugugcaccagccagauccuccugaugcgcacgaccugggcccugugcgaguccaucacccucgccaccggcccccugacgacccugugggaggggagcccgggcaaguucuggaacaccaccaucgccguguccauggcgaacaucuuccgggggagcuaccucgccggcgccggccuggccuucagccugaugaagucccucgggggcgggcgccggggcacgggggcgcagggcgagacccugggcgagaaguggaagcgccagcugaaccagcucagcaaguccgaguucaacaccuacaagcggagcgggaucauggaggucgaccgcuccgaggccaaggagggccugaagcgcggggagaccacgaagcacgccgugagccgcggcaccgccaagcugcggugguucguggagcgcaaccuggucaagcccgaggggaaggugaucgaccucggcugcggccgcggcgggugguccuacuacugcgccgggcugaagaaggugaccgaggucaagggguacaccaagggcgggcccggccacgaggagcccaucccgauggcgacguacggguggaaccuggugaagcuccacagcggcaaggacguguucuucaucccgcccgagaagugcgacacccugcugugcgacaucggggaguccagccccaacccgaccaucgaggagggccgcacccuccggguccugaagaugguggagcccuggcugcgcgggaaccaguucugcaucaagauccucaaccccuacaugcccuccguggucgagacgcuggagcagaugcagcggcgccacggcggcaugcuggugcggaacccgcucagccgcaacuccacccacgagauguacugggugagcugcgggaccggcaacaucgucuccgccgugaacaugaccagccgcaugcugcugaaccgguucaccauggcccaccgcaagcccacguacgagcgggacguggaccucggggccggcacccgccacgucgccguggagcccgagguggcgaaccuggacaucaucggccagcggaucgagaacaucaagcacgagcacaaguccaccuggcacuacgacgaggacaaccccuacaagaccugggccuaccacgggagcuacgaggucaagccguccggcagcgccagcuccauggugaacgggguggucaagcugcucacgaagcccugggacgugauccccauggucacccagaucgccaugaccgacaccacgcccuucggccagcagcgcguguucaaggagaagguggacacccggaccccgaaggccaagcgcgggaccgcgcagaucauggaggucacggccaaguggcuguggggcuuccugagccggaacaagaagccccgcaucugcacccgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggucccgcgcgaucugguacauguggcucggcgcccgguuccuggaguucgaggcccugggcuucaugaacgaggaccacugguucagccgcgagaacucccucagcgggguggagggcgaggggcugcacaagcugggcuacauccuccgggacaucuccaagauccccgggggcaacauguacgccgacgacacggccggcugggacacccgcaucaccgaggacgaccugcagaacgaggcgcgcaucaccgacaucauggagccggagcacgcccugcucgccaagagcaucuucaagcugacguaccagaacaaggugguccgggugcagcgccccgccaagaacgggaccgugauggacgucaucucccggcgcgaccagcggggcagcggccagguggggaccuacggccugaacaccuucacgaacauggaggcccagcucauccgccagauggaguccgaggggaucuucagccccuccgagcuggagacccccaaccuggcggagcgggugcucgacuggcuggagaaguacggcgucgagcgccugaagcggauggccaucagcggggacgacugcguggugaagccgaucgacgaccgcuucgccaccgcccucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcgcgggugagccagggggccggcuggucccugcgcgagacggccugccugggcaagagcuacgcccagauguggcagcucauguacuuccaccggcgcgaccugcggcuggcggccaacgccaucugcuccgccguccccguggacuggauccccaccagccgcaccaccugguccauccacgcccaccaccaguggaugacgaccgaggacaugcucagcguguggaaccgcgucuggaucgaggagaaccccuggauggaggacaagacccacaucuccagcuggggcgacgugccguaccuggggaagcgggaggaccaguggugcggcucccugaucggccucaccgcgcgcgccacgugggccaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8839 - RNA, 9879 nt, Artificial Sequence
  derived and/or modified CDS sequence (opt1) from DENV-1__JQ045667__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccauccugcggaagcucugcaucgaggcgaagaucuccaacaccacgaccaacagccgcugcccgacccagggcgaggccacccugguggaggagcaggacgccaacuucgugugccggcgcacguucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacacgggcgaccagcaccaggucgggaacgaguccaccgagcacggcaccaccgccaccaucacgccccaggcgcccaccaccgagauccagcucaccgacuacggggcccugacgcuggacugcagcccccgcaccggccucgacuucaacgagauggugcugcugaccaugaaggggaaguccuggcucguccacaagcagugguuccuggaccugccccuccccuggaccagcggcgccagcacgucccaggagaccuggaaccggcaggaccugcuggugaccuucaagaccgcccacgccaagaagcaggagguggucgugcucggcagccaggagggggcgaugcacacggcccugaccggcgccaccgagauccagaccuccgggacgaccaccaucuucgccggccaccugaagugccgccucaagauggacaagcugacccugaaggggaugagcuacgugaugugcacgggcuccuucaagcucgagaaggaggucgccgagacccagcacggcaccgugcuggugcagaucaaguacgaggggaccgacgcgcccugcaagauccccuucagcacgcaggacgagaagggcgucacccagaacgggcggcugaucaccgccaacccgaucgugaccgacaaggagaagcccgugaacaucgaggccgagccgcccuucggcgaguccuacaucgucaucggcgccggggagaaggcgcugaagcucagcugguucaagaagggcuccagcaucgggaagauguucgaggccacggcccgcggcgcccggcgcauggccauccugggggacaccgcgugggacuucggcuccaucggcgggguguucaccagcgugggcaagcugguccaccagaucuucgggaccgccuacggcguccucuucuccggggugagcuggacgaugaagaucggcaucggcguccugcugaccuggcucgggcugaacucccgcagcaccucccugagcaugaccugcaucgccgugggccucgugacgcuguaccugggggucauggugcaggccgacuccggcugcgugaucaacuggaaggggcgggagcucaagugcggcagcggcaucuucgucaccaacgaggugcacaccuggaccgagcaguacaaguuccaggccgacagcccgaagcgccuguccgcggccaucgggaaggccugggaggagggcgugugcgggauccggagcgccacccgccuggagaacaucauguggaagcagaucuccaacgagcucaaccacauccugcuggagaacgacaugaaguucacggucguggugggcgacgucgccgggauccucgcgcagggcaagaagaugauccggccccagcccauggaguacaaguacagcuggaaguccuggggcaaggccaagaucaucggggccgacgugcagaacaccaccuucaucaucgacggccccaacaccccggagugccccgacgaccagcgcgccuggaacaucugggagguggaggacuacggguucggcaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccgugguggucgacgagcacugcgggaaccggggcccgucccugcgcaccaccacggugaccgggaagaucauccacgaguggugcugccggagcugcacccugccgccccuccgcuuccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacgcuggccguguucuuccugcucaucaugggccagcugaccuggaacgaccugauccgccucugcaucauggugggggccaacgcgagcgaccgcaugggcaugggcaccaccuaccuggcccugauggccacguucaagaugcggccgauguucgccgucgggcuccuguuccgccggcugaccucccgcgaggugcuccugcugaccaucggccucagccugguggccuccgucgagcugcccaacagccucgaggagcugggggacggccuggcgaugggcaucaugauccucaagcugcugaccgacuuccaguccuaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcuggggagccucggcugcaagccgcugaccauguuccugaucgcggagaacaagaucugggggcggcgcuccuggccccucaacgagggcaucauggccguggggaucgucagcauccugcugagcucccuccugaagaacgacgugccccuggccggcccccucaucgccggcgggaugcugauggccugcuacgugaucagcggcuccagcgcggaccugucccucgagaaggccgccgaggucagcugggaggaggaggccgagcacuccggggccagccacaacauccugguggaggugcagggcgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccggcguccucugggacacccccagcccgcccgagguggggcgggccgugcuggacgacggcaucuaccgcaucaugcagcgggggcugcugggccgcucccaggucggggugggcguguuccaggagaacgucuuccacaccauguggcacgugacgcggggcgccgugcucauguaccaggggaagcgccuggagcccagcugggcguccgucaagaaggaccugaucagcuacggcgggggcuggcggcuccagggguccuggaacaccggcgaggagguccaggugaucgccgucgagcccggcaagaaccccaagaacgugcagaccgcccccgggaccuucaagacgcccgagggcgaggugggggccaucgcccuggacuucaagcccggcaccagcggcucccccaucgucaaccgcgaggggaagaucgugggccuguacgggaacggcguggucaccaccagcgggacguacgugagcgcgaucgcccaggccaaggccucccaggagggcccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccgggaaggagaucguggaccugaugugccacgccacguucaccaugcggcuccugucccccgugcgcgucccgaacuacaacaugaucaucauggacgaggcccacuucaccgaccccagcuccaucgccgcgcggggcuacaucagcacccgcguggggaugggcgaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcgggaacgacaucgccaacugccugcggaagaacggcaagcgcgucauccagcucucccggaagacguucgacaccgaguaccagaagaccaagaacaacgacugggacuacguggugaccacggacaucagcgagaugggggccaacuuccgcgcggaccgggucaucgacccgcgccggugccugaagcccgugauccugaaggacggccccgagcgcgugauccucgccggccccaugccggucaccguggccuccgccgcccagcggcgcgggcggaucggccgcaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccggcugcgcggcgaggcgcggaagacguucgucgagcucaugcgccgcggggaccugcccguguggcuguccuacaagguggccagcgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccgggggcgugacccucuucuuccuguccggccgggggcugggcaagaccagcaucgggcuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucggccuccuguucaugauccugaccgucgccgccaacgagauggggcuccuggagaccaccaagaaggaccugggcaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggggugccccuccuggcccugggcugcuacagccaggucaacccccucacgcugaccgccgcggugcugaugcucguggcccacuacgccaucaucgggccgggccugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccgggccccugaccacccucugggagggcuccccgggcaaguucuggaacacgaccaucgccgugagcauggccaacaucuuccggggguccuaccuggccggcgcggggcuggccuucagccucaugaagucccugggcgggggccgccggggcaccggggcccagggcgagacccugggggagaaguggaagcgccagcucaaccagcuguccaagagcgaguucaacaucuacaagcgguccggcaucauggagguggaccgcagcgaggccaaggaggggcugaagcggggcgagacgaccaagcacgcggucucccgcggcaccgccaagcuccggugguucguggagcgcaaccuggugaagcccgaggggaaggucaucgaccugggcugcgggcggggcggguggagcuacuacugcgccggccugaagaaggugaccgaggugaagggcuacacgaagggcgggcccgggcacgaggagcccaucccgauggccaccuacggcuggaaccucgucaagcugcacuccgggaaggacguguucuucaucccgcccgagaagugcgacacccugcucugcgacaucggcgagagcucccccaacccgaccaucgaggagggccgcacgcugcgggugcugaagauggucgagcccuggcuccgcgggaaccaguucugcaucaagauccugaaccccuacaugcccagcgugguggagacccuggagcagaugcagcggaagcacggcgggaugcucguccgcaacccgcugucccggaacagcacccacgagauguacuggguguccugcggcaccggcaacaucgugagcgccgucaacaugaccucccgcaugcugcucaaccgcuucacgauggcgcaccggaagcccaccuacgagcgcgacguggaccugggggccggcacccggcacguggccgucgagcccgagguggccaaccuggacaucaucgggcagcgcaucgagaacaucaagcacgagcacaagagcaccuggcacuacgacgaggacaaccccuacaagacgugggccuaccacggcuccuacgaggugaagccgagcggguccgcgagcagcauggucaacggcguggucaagcuccugaccaagcccugggacgugauccccauggugacccagaucgccaugaccgacacgacccccuucggccagcagcgggucuucaaggagaagguggacacccgcaccccgaaggccaagcgggggacgauccagaucauggaggugaccgccaaguggcuguggggcuuccucucccgcaacaagaagccccggaucugcacccgcgaggaguucacccggaagguccgcagcaacgccgcgaucggggccguguucguggacgagaaccaguggaacuccgccaaggaggccgucgaggacgagcgguucugggaccuggugcaccgcgagcgggagcugcacaagcagggcaagugcgcgacgugcguguacaacaugauggggaagcgcgagaagaagcucggcgaguucggcaaggccaaggggagccgggccaucugguacauguggcugggcgcccgcuuccuggaguucgaggcccucggguucaugaacgaggaccacugguucucccgggagaacagccuguccggcgucgagggggagggccugcacaagcucggcuacauccugcgcgacaucagcaagauccccgggggcaacauguacgcggacgacaccgccgggugggacacccggaucaccgaggacgaccugcagaacgaggcccgcaucacggacaucauggagccggagcacgcccuccuggccaaguccaucuucaagcugaccuaccagaacaagguggugcgcguccagcggcccgcgaagaacggcaccgugauggacgugaucagccgccgggaccagcgcggcuccgggcaggucggcaccuacgggcucaacacguucaccaacauggaggcccagcugauccggcagauggagagcgagggcaucuucucccccagcgagcuggagacccccaaccucgccgagcgcgugcuggacuggcuggagaaguacgggguggagcggcucaagcgcauggccaucuccggcgacgacugcgucgugaagccgaucgacgaccgguucgccaccgcgcugacggcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucgggcgggcccgcgugagccagggcgccggguggagccugcgggagaccgccugccucggcaaguccuacgcgcagauguggcagcugauguacuuccaccgccgggaccugcgccucgccgccaacgccaucugcagcgcggugcccgucgacuggauccccaccucccggaccacguggagcauccacgcccaccaccaguggaugaccaccgaggacaugcuguccguguggaaccgcguguggaucgaggagaaccccuggauggaggacaagacccacaucagcuccuggggcgacgucccguaccuggggaagcgcgaggaccaguggugcggcagccucaucgggcugacggcccgggccaccugggccaccaacauccagguggcgaucaaccaggugcgccggcugaucggcaacgagaacuaccucgacuacaugaccuccaugaagcgcuucaagaacgagagcgaccccgagggggcccugugguga

SEQ ID NO: 8840 - RNA, 9879 nt, Artificial Sequence
  derived and/or modified CDS sequence (opt1) from DENV-1__KU094071__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccgcaucaccaaggccgagcccgacgacguggacugcuggugcaacgccaccgacacgugggucaccuacgggaccugcagccagaccggcgagcaccggcgcgacaagcgguccguggcccuggcgccccacgugggccuggggcucgagacgcgcgccgagaccuggaugagcuccgagggcgccuggaagcagauccagaaggucgagaccugggcccugcggcacccgggguucaccgugaucgcgcuguuccucgcccacgccaucggcacgagcaucacccagaaggggaucaucuucauccugcugaugcucgugacccccuccauggccaugcgcugcgucggcaucggcaaccgggacuucguggaggggcugagcggcgggaccuggguggacgucgugcuggagcacggcuccugcgugacgaccauggccaaggacaagcccacccucgacaucgagcugcugaagaccgaggucacgaaccccgcggugcuccgcaagcugugcaucgaggccaagaucagcaacaccaccaccgacucccggugcccgacgcagggcgaggccacccugguggaggagcaggacgccaacuucgucugccgccggaccuucguggaccgcggguggggcaacgggugcggccucuucgggaagggcagccugaucaccugcgccaaguucaagugcgugacgaagcuggagggcaagaucguccaguacgagaaccucaaguacuccgugaucgugaccguccacaccggggaccagcaccaggugggcaacgagaccacggagcacgggaccaucgcgaccaucaccccccaggcccccaccagcgagauccagcugacggacuacggcgcccugacccucgacugcuccccccggaccgggcuggacuucaacgagaugguccugcucaccaugaagcgcaagagcuggcuggugcacaagcagugguuccuggaccucccgcugcccuggacguccggcgccagcaccccccaggagaccuggaaccgggaggaccugcucgugaccuucaagacggcccacgcgaagaagcaggaggucguggugcugggcagccaggagggggccaugcacaccgcccugaccggcgccaccgagauccagacguccgggaccaccaagaucuucgccggccaccucaagugccgccugaagauggacaagcugacccucaaggggaugagcuacgucaugugcacgggcuccuucaagcuggagaaggagguggcggagacccagcacggcaccgugcugguccaggugaaguacgaggggaccgacgcccccugcaagaucccguucagcacgcaggacgagaagggcgugacccagaacgggcggcugaucaccgccaaccccaucgucaccgacaaggagaagcccgugaacaucgaggccgagcccccguucggcgaguccuacaucguggucggcgcgggggagaaggcccucaagcugagcugguucaagaagggcuccagcaucgggaagaugcuggaggccacggcccgcggcgcccggcgcauggcgauccucggggacaccgccugggacuucggcuccaucggcgggguguucaccagcgugggcaagcugguccaccagaucuucgggaccgccuacggcgugcuguucuccggggugagcuggacgaugaagaucggcaucggcauccuccugaccuggcuggggcucaacucccgcagcgccucccugagcaugaccugcaucgccgucggcauggugacccuguaccucggggugaugguccaggcggacuccggcugcgugaucaacuggaaggggcgggagcugaagugcggcagcggcaucuucgugacgaacgagguccacaccuggaccgagcaguacaaguuccgcgccgacucccccaagcggcugagcgccgccaucgggaaggccugggaggagggcgugugcgggauccgcagcgcgacccggcucgagaacaucauguggaagcagaucuccaacgagcugaaccacauccugcucgagaacgacaugaaguucacgguggucgugggcgacgugagcgggauccugacccagggccgcaagaugaucggcccccagcccauggagcacaaguacuccuggaagagcugggggaaggccaagaucaucggcgccgacguccagaacaccaccuucaucaucgacgggccgaacacccccgagugccccgacgaccagcgggccuggaacaucugggagguggaggacuacggcuucggcaucuucacgaccaacaucuggcugaagcuccgcgacuccuacacccaggugugcgacccccggcugaugagcgcggccaucaaggacuccaaggccguccacgccgacaugggguacuggaucgagagcgagaagaacgagaccuggcgccuggcccgggcguccuucaucgaggugaagacgugcguguggccgaagagccacacccucugguccaacggcguccuggagagcgagaugaucauccccaagaucuacgggggccccaucucccagcacaacuaccgcccgggguacagcacccagaccgccggccccuggcaccugggcaagcucgagcuggacuucgaccugugcgaggggacgaccgugguggucgacgagcacugcggcaaccgggggcccucccuccgcaccaccacggugaccggcaagaucauccacgaguggugcugccggagcugcacccugcccccgcugcgcuucaagggggaggacggcugcugguacggcauggagauccggcccgugaaggacaaggaggagaaccucgucaagucccuggugagcgccgggagcggcgagguggacuccuucagccuggggcuccugugcgucuccaucaugaucgaggaggugaugcgcagccgguggucccgcaagaugcugaugaccggcacgcucgccguguuccugcugcucaucauggggcagcugaccuggaacgaccugauccgccucugcaucauggucggcgccaacgcgagcgaccggaugggcauggggaccaccuaccuggcccugaucgccacguucaagaugcgccccauguucgccgugggccuccuguuccggcgccugaccucccgggagguccuccugcugaccaucgggcucagccugguggccuccguggagcugcccaacagccucgaggagcugggcgacggccuggcgauggggaucaugauccucaagcugcugaccgacuuccagucccaccagcucugggccgcccugcugagccucacguucaucaagaccaccuucucccugcacuacgccuggaagaccauggcgaugguccugagcacggugucccucuucccgcugugccugagcaccaccucccgcaagaccacguggcuccccgugcugcugggcagccucgggugcaagccccugaccauguuccugaucgccgagaacaagaucuggggccggaaguccuggccccucaacgaggggaucauggccgucggcaucgugagcauccugcugagcucccuccugaagaacgacgugccgcuggccggcccccucaucgccgggggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugacgauccuccugaaggccacccugcucgccguguccggcguguaccccaucagcauccccgccacccuguucgucugguacuuccggcagaagaagaagcagcgcuccggcgugcugugggacaccccgagcccccccgagguggagcgggccguccuggacgacgggaucuaccgcauccuccagcggggccugcuggggcgcucccaggugggcgugggggucuuccaggagggcguguuccacaccauguggcacgugacgcggggcgcgguccucauguaccaggggaagcgccuggagcccagcugggccuccgugaagaaggaccugaucagcuacggcgggggcuggcgguuccagggguccuggaacaccggcgaggaggugcaggucaucgccguggagccgggcaagaaccccaagaacgugcagaccgcccccgggaccuucaagacgcccgagggcgaggucggggugaucgcccucgacuucaagccgggcaccagcggcucccccaucgugaaccgcgaggggaagaucgucggccuguacgggaacggcguggugaccaccagcgggacguacgucagcgcgaucgcccaggccaaggccucccaggagggcccccugccggagaucgaggacgagguguuccggaagcgcaaccucaccaucauggaccugcaccccggcagcgggaagacccggcgcuaccugcccgcgaucgugcgcgaggccaucaagcggaagcuccgcacccugauccuggcccccacgcgggucguggccuccgagauggccgaggcgcucaagggcaugccgauccgcuaccagaccaccgccgugaagagcgagcacaccgggcgggagaucgucgaccugaugugccacgccacguucaccaugcgccugcucucccccgugcgggugcccaacuacaacaugaucaucauggacgaggcccacuucaccgaccccgccagcaucgcggcccgcggcuacaucuccacccgggucgggaugggcgaggccgccgccaucuucaugacggcgaccccgcccggcagcguggaggccuucccccaguccaacgccgugauccaggacgaggagcgcgacauccccgagcggagcuggaacuccggguacgacuggaucaccgacuucccgggcaagaccgucugguucgugcccagcaucaaguccgggaacgacaucgccaacugccugcgcaagaacggcaagcgggugauccagcugagccgcaagacguucgacaccgaguaccagaagaccaagaacaacgacugggacuacgucgugaccacggacaucuccgagaugggggcgaacuuccgggccgaccgcgucaucgacccccggcgcugcagcaagcccgugauccucaaggacggcccggagcgggugauccuggccggccccaugcccgucaccguggccuccgccgcgcagcgccgcgggcggaucggccgcaaccagaacaaggagggggaccaguacaucuacaugggccagccccugaacaacgacgaggaccacgcccacuggaccgaggccaagaugcuccuggacaacaucaacaccccggaggggaucauccccgcccuguucgagcccgagcggggcaagagcgccgcgaucgacggcgaguaccgccuccggggggaggcccgcaagacguucguggagcugaugcggcgcggcgaccugcccgucuggcucuccuacaagguggccagcgagggguuccaguacagcgaccggaaguggugcuucgacggcgagcgcaacaaccaggugcuggaggagaacauggacgucgagaucuggaccaaggagggcgagcggaagaagcugcgcccgcgguggcucgacgcccgcaccuacuccgacccccaggcccugcgggaguucaaggaguucgcggccgggcgccggagcguguccggcgaccugauccucgagaucgggaagcugccccagcaccugacccagcgcgcccagaacgcccucgacaaccuggugaugcugcacaacagcgagcagggcgggaaggcguaccggcacgccauggaggagcuccccgacacgaucgagacccugaugcugcucgcccugaucgccguccugaccggcggcgugacccucuucuuccuguccgggcgcggccuggggaagacgagcaucggccuccugugcgugauggccuccagcguccugcucuggguggcguccguggagccgcacuggaucgccgccagcaucauccuggaguucuuccugaugguccuccugauccccgagcccgaccggcagcgcaccccgcaggacaaccagcuggccuacguggugaucgggcuccuguucaugauccugaccgucgccgcgaacgagaugggccuccuggagaccaccaagaaggaccugggcaucgggcacguggccguggagaaccaccaccacgccacgaugcucgacgucgaccugcgccccgccuccgccuggacccuguacgcgguggccaccaccaucaucacgcccaugaugcggcacaccaucgagaacaccaccgccaacaucagccucacggccaucgccaaccaggcggccauccugaugggccuggacaagggguggcccaucuccaagauggacaucggcgugccgcuccuggcccuggggugcuacagccaggucaacccccccacccucaucgccgcggugcugaugcugguggcccacuacgccaucaucggccccggccuccaggccaaggccacccgcgaggcgcagaagcggaccgccgccgggaucaugaagaacccgacggucgacggcaucguggccaucgaccuggaccccguggucuacgacgccaaguucgagaagcagcuggggcagaucaugcuccugauccugugcaccucccagauccucagcaugcgcaccaccugggcgcugugcgaguccaucacgcuggccaccggcccccucaccacccugugggagggcagccccgggaaguucuggaacacgaccaucgccguguccauggccaacaucuuccggggcagcuaccuggccggggcgggccucgccuucccgcugaugaagagccuggggggcggccgccgggggaccggcgcccagggggagacccucggcgagaaguggaagcgccagcugaaccagcuguccaagagcgaguucaacacguacaagcgguccgggaucauggagguggaccgcagcgaggccaaggagggccucaagcggggcgagaccaccaagcacgcggucucccgcgggaccgccaagcugcggugguucguggagcgcaaccuggugaagcccgagggcaaggucaucgaccucgggugcggccgggggggcuggagcuacuacugcgccggccugaagaaggugacggaggugaagggguacaccaagggcgggcccggccacgaggagcccaucccgauggccaccuacggguggaaccuggucaagcugcacuccggcaaggacguguucuucaccccccccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacgggggcaugcugguccgcaacccgcugucccgcaacagcacgcacgagauguacuggguguccugcggcaccgggaacaucgugagcgccgucaacaugaccucccggaugcuccugaaccgcuucaccauggcgcaccggaagcccaccuacgagcgcgacguggaccugggcgccgggacgcggcacgucgccguggagcccgagguggccaaccucgacaucaucggccagcgcaucgagaacaucaagaacgagcacaagagcaccuggcacuacgacgaggacaaccccuacaagaccugggccuaccacggguccuacgaggucaagccgagcggcuccgcgagcagcauggugaacggcgugguccggcugcugaccaagcccugggacgugauccccauggugacgcagaucgccaugaccgacaccaccccguucgggcagcagcgcgucuucaaggagaagguggacacgcggacccccaaggccaagcgcggcaccgcccagaucauggaggugaccgcccgguggcucuggggguuccugucccgcaacaagaagccccggaucugcacgcgcgaggaguucacccggaagguccgcagcaacgcggccaucggcgccguguucguggacgagaaccaguggaacuccgccaaggaggcggucgaggacgagcgguucugggaccuggugcaccgcgagcgggagcuccacaagcaggggaagugcgccaccugcguguacaacaugaugggcaagcgcgagaagaagcugggcgaguucgggaaggccaagggcagccgggccaucugguacauguggcugggggcccgcuuccucgaguucgaggcgcugggcuucaugaacgaggaccacugguucucccgcgagaacagccuguccggggucgagggcgagggccuccacaagcugggguacauccugcgggacaucagcaagauccccggcgggaacauguacgccgacgacaccgccggcugggacacgcgcaucaccgaggacgaccuccagaacgaggccaagaucaccgacaucauggagccggagcacgcccugcuggcgaccuccaucuucaagcucacguaccagaacaagguggugcggguccagcgccccgccaagaacggcaccgugauggacgugaucagccggcgcgaccagcggggguccggccaggucgggaccuacggccugaacaccuucacgaacauggaggugcagcugauccgccagauggagagcgaggggaucuucucccccagcgagcucgagacccccaaccuggccgagcgggugcuggacuggcucgagaagcacggcgucgagcgccugaagcggauggccaucuccggcgacgacugcguggugaagccgaccgacgaccgcuucgccaccgcgcugacggcccucaacgacauggggaagguccggaaggacaucccccagugggagcccagcaagggcuggaacgacuggcagcaggugcccuucugcucccaccacuuccaccagcugaucaugaaggacgggcgcgagaucguggucccgugccggaaccaggacgagcuggugggccgcgcccgggugagccagggggccggcuggagccuccgcgagaccgccugccugggcaaguccuacgcgcagauguggcagcugauguacuuccaccggcgcgaccuccgccuggccgccaacgccaucugcagcgcgguccccaucgacugggugcccaccucccggaccacguggagcauccacgcccaccaccaguggaugaccaccgaggacaugcuguccguguggaaccgcgucuggaucgaggagaaccccuggauggaggacaagacccacgugagcuccugggaggacgugccguaccucgggaagcgggaggaccaguggugcggcagccugaucgggcugacggcccgcgccaccugggccaccaacauccaggucgcgaucaaccaggugcggcgccucaucggcaacgagaacuaccuggacuacaugaccuccaugaagcgguucaaggacgagagcgaccuggagggggcccucugguga

SEQ ID NO: 8841 - RNA, 9879 nt, Artificial Sequence
  derived and/or modified CDS sequence (opt1) from DENV-1__HQ624983__SS-prME
agcgugaccaugcugcucaugcuggugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacgucgacugcuggugcaacgccaccgacaccugggugaccuacgggaccugcucccagaccggcgagcaccggcgcgacaagcggagcguggcccuggcgccccacgucggccucgggcuggagacccggacggagaccuggauguccagcgagggcgccuggaagcagauccagcggguggagaccugggcccugcgccaccccggguucaccgugaucgcccucuuccuggcgcacgccaucggcacguccaucacccagaaggggaucaucuucauccugcucaugcuggucacccccagcauggccaugcggugcgugggcaucggcucccgcgacuucguggaggggcugagcggcgccaccugggucgacguggugcucgagcacggguccugcgucacgaccauggccaaggacaagcccacccuggacaucgagcugcucaagaccgaggugacgaaccccgcggugcugcggaagcugugcaucgaggccaagaucagcaacaccaccaccgacucccgcugcccgacgcagggcgaggccacccucgucgaggagcaggacgccaacuucgugugccggcgcaccuucguggaccggggcugggggaacggcugcgggcuguucggcaaggggagccugaucacgugcgccaaguucaagugcgucacgaagcucgagggcaagaucgugcaguacgagaaccugaaguacuccgugaucgucaccgugcacaccggcgaccagcaccaggucgggaacgagagcaccgagcacggcacgaccgcgaccaucacgccccaggcccccuccaccgagauccagcugacggacuacggggcccucacccuggacugcagcccccgcaccggccuggacuucaacgagauggugcuccugaccaugaaggagaaguccuggcuggugcacaagcagugguuccucgaccugccgcugcccuggacguccggggccagcaccucccaggagaccuggaaccggcaggaccuccuggucaccuucaagacggcccacgcgaagaagcaggagguggugguccugggcagccaggagggcgccaugcacaccgcccucaccggggccaccgagauccagacguccggcaccaccaccaucuucgccgggcaccugaagugccgccugaagauggacaagcucacgcugaagggcaugagcuacgugaugugcaccggguccuucaagcuggagaaggagguggcggagacccagcacggcaccguccucgugcagaucaaguacgagggcacggacgcccccugcaagauccccuucagcacccaggacgagaagggggugacccagaacggccggcugaucaccgccaacccgaucgucacggacaaggagaagcccgugaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcgucuucaccagcguggggaagcuggugcaccagaucuucggcacggccuacgggguccuguucuccggcgugagcuggaccaugaagaucgggaucggcgugcuccugaccuggcugggccucaacucccgcagcaccucccugagcaugacgugcaucgccgucgggcuggugacccucuaccugggcgugaugguccaggccgacagcgggugcgugaucaacuggaagggccgggagcugaagugcggguccggcaucuucgugaccaacgagguccacaccuggacggagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacacgccggagugccccgacgaccagcgcgcguggaacaucugggagguggaggacuacggcuucgggaucuucaccaccaacaucuggcucaagcugcgggacagcuacacccaggugugcgaccaccgccugauguccgccgccaucaaggacagcaaggccguccacgccgacaugggcuacuggaucgaguccgagaagaacgagacguggaagcucgcgcgggccagcuucaucgaggugaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccgucgugguggacgagcacugcggcaaccgggggccgucccugcgcaccacgaccgucaccggcaagaucauccacgaguggugcugccggagcugcacccugccgccccugcgcuucaagggggaggacggcugcugguacgggauggagauccggcccgugaaggagaaggaggagaaccuggucaagagcauggucuccgccggcagcggcgagguggacuccuucagccuggggcuccugugcaucuccaucaugaucgaggaggugaugcgcagccgguggucccgcaagaugcugaugacgggcacccucgccgucuucuuccugcugaucauggggcagcucaccuggaacgaccugauccggcugugcaucauggugggcgcgaacgccagcgaccgcauggggaugggcaugaccuaccucgcccugauggccacguucaagaugcgcccgauguucgccgugggccuccuguuccggcgccugaccucccgggagguccugcuccugaccaucgggcugagccucguggcguccgucgagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgauggugcugagcaucgugucccuguucccccucugccugagcaccaccucccagaagaccacguggcugcccguccuccugggcagccuggggugcaagccgcucaccauguuccugaucgccgagaacaagaucuggggccgcaagagcuggccccugaacgaggggaucauggccgugggcaucguguccauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugacgauccugcucaaggccacccugcuggccguguccggcgucuacccgcucagcauccccgccacccuguucgugugguacuucuggcagaagaagaagcagcgcuccggggugcugugggacacccccagcccgcccgaggucgagcgggccgugcucgacgacggcaucuaccgcaucaugcagcggggccugcuggggcgcucccaggugggcgucgggguguuccaggagaacguguuccacaccauguggcacgucacgcggggcgcggugcugauguaccaggggaagcgccucgagcccagcugggccuccgugaagaaggaccugaucagcuacggcggcggguggcggcugcagggcuccuggaacaccggggaggagguccaggugaucgccguggagcccggcaagaaccccaagaacguccagaccgcccccgggaccuucaagacgagcgagggcgaggugggcgccaucgcgcucgacuucaagcccgggaccagcggcucccccaucgugaaccgcgaggggaagaucgucggccuguacggcaacgggguggugaccaccagcggcacguacgucuccgccaucgcccaggccaaggcgagccaggaggggccccugccggagaucgaggacgagguguuccggaagcgcaaccucaccaucauggaccugcaccccggcuccgggaagacccggcgcuaccugcccgccaucgugcgggaggccaucaagcgcaagcuccggacccugauccuggccccgacgcgcgucguggccagcgagauggcggaggcccucaagggcaugcccauccgcuaccagaccaccgccgugaaguccgagcacaccggcaaggagaucgucgaccugaugugccacgccacguucaccaugcggcugcucagccccgugcgcgugcccaacuacaacaugaucaucauggacgaggcccacuucaccgacccguccagcaucgcggcccggggguacaucuccacccgcgucggcaugggggaggccgccgccaucuucaugacggcgacgccgcccggcagcguggaggccuucccccaguccaacgccgugauccaggacgaggagcgggacaucccggagcgcagcuggaacuccggguacgaguggaucaccgacuuccccggcaagaccgucugguucgugcccagcaucaaguccggcaacgacaucgccaacugccugcggaagaacgggaagcgcgugauccagcugagccggaagacguucgacaccgaguaccagaagaccaagaacaacgacugggacuacgucgugaccacggacaucuccgagaugggcgcgaacuuccgcgccgaccgggugaucgacccccgccggugccucaagccggucauccugaaggacgggcccgagcgcgugauccuggccggccccaugcccgucaccguggccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccggucuggcuguccuacaagguggccagcgagggcuuccaguacuccgaccgccgguggugcuucgacggcgagcgcaacaaccaggugcuggaggagaacauggacgucgagaucuggaccaaggagggggagcggaagaagcuccgcccccgguggcuggacgcccgcaccuacagcgacccccuggcccuccgggaguucaaggaguucgcggccggccgccgguccgugagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccguccugaccggcggggugacccuguucuuccucagcggccgggggcugggcaagacguccaucggccugcucugcgugauggccagcuccguccugcuguggauggcgagcguggagccccacuggaucgccgccuccaucauccucgaguucuuccugauggugcugcucauccccgagcccgaccgccagcggaccccgcaggacaaccagcuggccuacgucgugaucgggcuccucuucaugauccugaccguggccgcgaacgagaugggccugcucgagaccaccaagaaggaccuggggaucggccacgucgccguggagaaccaccaccacgccgccaugcuggacguggaccuccaccccgccagcgcguggacgcuguacgccgucgccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgugccccugcucgcccuggggugcuacucccaggugaacccccugacgcucaccgcggccguccugaugcugguggcccacuacgccaucaucggccccgggcuccaggccaaggcgacccgggaggcccagaagcgcaccgccgccggcaucaugaagaacccgacgguggacgggaucgucgccaucgaccuggaccccgugguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgucagcauggccaacaucuuccggggguccuaccucgcgggcgccggccuggccuucagccugaugaagucccucgggggcgggcgccggggcaccggggcccagggcgagacccugggcgagaaguggaagcgccagcugaaccaccucagcaaguccgaguucaacacguacaagcggagcgggaucauggagguggaccgcuccgaggcgaaggagggccugaagcgcggggagaccaccaagcacgccgugagccgcggcaccgccaagcugcggugguucgucgagcgcaaccucgugaagccggaggggaaggugaucgaccugggcugcggccgcggcgggugguccuacuacugcgccgggcugaagaaggucacggaggugaagggguacaccaagggcggccccggccacgaggagcccauccccauggccaccuacggguggaaccuggugaagcuccacagcggcaaggacgucuucuucgugccgcccgagaagugcgacacccugcugugcgacaucggggaguccagccccaaccccacgaucgaggagggccgcacccuccgggugcugaagauggucgagccguggcugcgcgggaaccaguucugcaucaagauccucaaccccuacaugcccuccgugguggagacccuggagcagaugcagcggaagcacggcggcaugcugguccgcaacccccucagccggaacuccacccacgagauguacugggugagcugcgggacgggcaacaucguguccgcggucaacaugaccagccgcaugcugcugaaccgguucaccauggcccaccgcaagccgaccuacgagcgcgacguggaccucggggccggcacccggcacguggccgucgagcccgagguggccaaccuggacaucaucggccagcgcaucgagaacaucaagcacgagcacaaguccacguggcacuacgacgaggacaaccccuacaagaccugggcguaccacgggagcuacgaggucaagcccagcggcuccgccagcuccauggugaacgggguggucaagcugcucaccaagccgugggacgugauccccauggugacccagaucgccaugacggacaccacccccuucggccagcagcgggucuucaaggagaagguggacacccgcacgcccaaggccaagcgggggaccgcccagaucauggaggugaccgcgaaguggcuguggggcuuccugagccgcaacaagaagccgcggaucugcacccgcgaggaguucacgcggaagguccgcuccaacgccgccaucggcgccguguucguggacgagaaccaguggaacagcgcgaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcggggucgagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaacuccaucuucaagcugaccuaccagaacaagguggugcgcguccagcggcccgccaagaacgggaccgugauggacgugaucagccgccgcgaccagcggggcuccgggcaggucggcacguacggccugaacaccuucaccaacauggaggcccagcucauccgccagauggagagcgaggggaucuucuccccgagcgagcuggagacccccaaccuggccgagcgggugcucgacuggcuggagaaguacggcguggagcgccugaagcggauggcgaucagcggggacgacugcgucgugaagcccaucgacgaccgcuucgccacggcccucaccgcccugaacgacaugggcaaggugcggaaggacaucccccagugggagccguccaagggguggaacgacuggcagcagguccccuucugcagccaccacuuccaccagcugaucaugaaggacggccgcgagaucguggugcccugccggaaccaggacgagcucgucggccgcgcccgggugucccagggggcgggcuggagccugcgcgagaccgccugccuggggaaguccuacgcccagauguggcagcucauguacuuccaccggcgcgaccugcggcuggccgcgaacgccaucugcagcgccgugcccgucgacugggugccgaccucccgcacgaccuggagcauccacgcccaccaccaguggaugaccgccgaggacaugcucuccguguggaaccgggucuggaucgaggagaaccccuggauggaggacaagacccacaucagcuccugggaggacgugcccuaccugggcaagcgcgaggaccaguggugcgggagccugaucggccucacggcgcgggccaccugggccaccaacauccagguggccaucaaccagguccgccgccugaucggcaacgagaacuaccuggacuacaugaccuccaugaagcgguucaagaacgagagcgaccccgagggggcccucugguga

SEQ ID NO: 8842 - RNA, 9879 nt, Artificial Sequence
  derived and/or modified CDS sequence (opt1) from DENV-1__FJ384655__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacggucguggugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacgagcagcgggccuggaacaucugggaggucgaggacuacggcuucgggaucuucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagacgugcaucuggcccaagagccacacccucugguccaacggcguccuggagagcgagaugaucauccccaagaucuacgggggcccgaucucccagcacaacuaccggcccggguacuucacccagaccgccggccccuggcaccuggggaagcucgagcuggacuucgaccugugcgagggcacgaccgugguggucgacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgucagcaucaugaucgaggaggugaugcggucccgcuggagccggaagaugcucaugaccggcacgcuggccguguuccugcuccugaucauggggcagcugaccuggaacgaccucauccgccugugcaucauggucggcgccaacgcguccgacaagauggggaugggcaccaccuaccuggcccucauggccacguucaagaugcgcccgauguucgccgugggccugcuguuccggcgccucgccagccgggaggugcugcugcucaccaucgggcugucccuggucgcgagcguggagcuccccaacucccuggaggagcugggcgacgggcucgccaugggcaucaugaugcugaagcugcucaccgaguuccagccccaccaccuguggaccacgcugcucagccugaccuucaucaagaccacccugucccucgacuacgccuggaagacgaccgccaugguccugagcaucgugucccuguucccccucugccugagcaccaccucccagaagacgaccuggcugccggugcuccugggcagcuucgggugcaagccccugaccauguuccucaucaccgagaacaagaucuggggccgcaaguccuggccccugaacgaggggaucauggcgaucggcaucgucagcauccugcucuccagccugcugaagaacgacgugccccucgccgggccgcugaucgccggcggcaugcugaucgccugcuacgugaucagcggguccagcgccgaccucucccuggagaaggcggccgaggucagcugggaggaggaggccgagcacuccggcaccagccacaacauccugguggaggugcaggacgacggggccaugaagaucaaggacgaggagcgggacgacacgcucaccauccugcugaaggccacccuccuggcggucuccggcguguaccccaugagcauccccgccacccuguucgugugguacuucuggcagaagaagaagcagcgcuccgggguccucugggacacgcccagcccgcccgagguggagggcgccgugcuggacgacggcaucuaccggauccugcagcgcgggcugcucggccggucccaggucggggugggcguguuccaggacggggucuuccacaccauguggcacgugacccgcggcgccgugcugauguaccagggcaagcggcuggagcccagcugggccuccgucaagaaggaccucaucagcuacgggggcggguggcgcuuccagggcuccuggaacaccggggaggagguccaggugaucgcggucgagcccggcaagaacccgaagaacgugcagacgacccccggcaccuucaagacccccgagggggaggugggcgccaucgcccuggacuucaagcccgggacgagcggcuccccgaucgucagccgggagggcaagaucguggggcuguacggcaacgggguggucaccaccuccggcaccuacgugagcgccaucgcccaggcgaaggccagccaggaggggccccuccccgagaucgaggacgagguguucaagaagcgcaaccugacgaucauggaccugcacccgggcuccggcaagacccggcgcuaccuccccgccaucguccgggaggccaucaagcgcaagcugcggacccugauccucgcgcccacccgcgugguggccagcgagauggccgaggcccugaaggggaugcccauccgguaccagacgaccgccgucaaguccgagcacaccggccgcgagaucguggaccugaugugccacgcgaccuucacgaugcgccuccugagcccggugcggguccccaacuacaacaugaucaucauggacgaggcccacuucaccgaccccgccuccaucgccgcccgcggguacaucagcacccgggugggcaugggggaggcggccgccaucuucaugaccgccacgcccccgggcuccguggaggccuucccccagagcaacgcggucauccaggacgaggagcgcgacauccccgagcgguccuggaacagcggcuacgacuggaucaccgacuuccccgggaagaccgugugguucgugccguccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgccaacuuccgggccgaccgcgucaucgacccccggcgcugccugaagcccgugauccugaaggacgggcccgagcgggugauccucgcgggcccgaugcccgucacgguggccuccgccgcccagcgccggggccgcaucgggcggaaccagaacaaggagggcgaccaguacgucuacauggggcagccccugaacaacgacgaggaccacgcccacuggaccgaggcgaagaugcugcucgacaacaucaacacccccgagggcaucaucccggcccuguucgagcccgagcgcgagaaguccgccgccaucgacgggggcuaccggcugcgcggcgaggcccgcaagaccuucguggagcucaugcggcgcggggaccugcccguguggcuguccuacaaggucgcgagcgagggcuuccaguacuccgaccggcgcuggugcuucgacggggagcggaacaaccaggugcucgaggagaacauggacguggagaucuggacgaaggagggcgagcgcaagaagcugcggccccgcuggcuggacgcccggaccuacagcgacccgcucgcccugcgcgaguucaaggaguucgccgccggccggcgcagcgucuccggggaccugauccucgagaucggcaagcugccccagcaccugacccuccgggcgcagaacgcccuggacaaccuggugaugcuccacaacagcgagcagggcgggaaggccuaccgccacgccauggaggagcugcccgacaccaucgagacccugaugcuccuggcgcugaucgccgugcucaccggcggggucacccuguucuuccuguccgggaaggggcucggcaagaccagcaucgggcugcugugcgugaccgccuccagcgcccuccuguggauggccuccguggagccccacuggaucgcggccagcaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucggccacguggcggccgagaaccaccagcacgccacgaugcuggacguggaccugcggccggccuccgccuggacccucuacgcggucgccaccaccgugaucacgcccaugaugcgccacaccaucgagaacaccaccgccaacaucagccugacggccaucgccaaccaggcggccauccugauggggcucgacaagggcuggcccaucuccaagauggacaucggggugccccugcuggcccucggcugcuacagccaggucaacccgcugacccugaccgccgcggugcucaugcugguggcccacuacgccaucaucgggcccggccugcaggccaaggccacccgggaggcgcagaagcgcacggccgccggcaucaugaagaaccccaccgucgacgggaucguggccaucgaccucgaccccguggucuacgacgccaaguucgagaagcagcugggccagaucaugcugcucauccugugcaccucccagauccugcucaugcggaccacgugggcgcugugcgagagcaucacccuggccaccgggccgcucaccacgcugugggagggcucccccggcaaguucuggaacaccaccaucgccgugagcauggccaacaucuuccgcggguccuaccuggccggcgcggggcucgccuucagccugaugaagucccugggcgggggccgccggggcaccggggcccagggcgagacgcucggggagaaguggaagcgccagcugaaccagcugagcaagagcgaguucaacaccuacaagcgguccggcaucauggagguggaccgcagcgaggccaaggaggggcucaagcggggcgagaccaccaagcacgcggucucccgcggcacggccaagcugcggugguucguggagcgcaaccuggugaagcccgaggggaaggucaucgaccugggcugcgggcggggcggguggagcuacuacugcgccggccucaagaaggugaccgaggugaagggcuacaccaagggcgggcccgggcacgaggagccgguccccauggccaccuacggcuggaaccuggugaagcugcacuccgggaaggacguguucuucaugccgcccgagaagugcgacacccuccugugcgacaucggcgagagcuccccgaaccccacgaucgaggagggccgcacccugcggguccucaagaugguggagcccuggcugcgcgggaaccaguucugcaucaagauccugaaccccuacaugccgagcguggucgagacccucgagcagaugcagcggaagcacggcgggaugcuggugcgcaacccccugucccggaacagcacccacgagauguacuggguguccugcggcacgggcaacaucgucagcgccgugaacaugaccucccgcaugcuccugaaccgguucaccauggcgcaccgcaagcccaccuacgagcgggacguggaccugggggccggcacgcgccacgucgccguggagcccgagguggccaaccucgacaucaucgggcagcgcaucgagaacaucaagaacgagcacaagagcaccuggcacuacgacgaggacaacccguacaagaccugggccuaccacggcuccuacgaggucaagcccagcggguccgcgagcuccauggugaacggcgucgugcggcugcugaccaagcccugggacgugauccccauggucacgcagaucgccaugaccgacaccaccccguucggccagcagcgcguguucaaggagaagguggacacgcggacgccccgggccaagcgggggaccgcccagaucauggaggucaccgccaaguggcucuggggcuuccugagccgcaacaagaagccccggaucugcacgcgcgaggaguucacccggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgcgaccugcgucuacaacaugauggggaagcgcgagaagaagcugggcgaguucggcaaggccaaggggagccgggccaucugguacauguggcugggcgcccgcuuccucgaguucgaggcgcugggguucaugaacgaggaccacugguucucccgggagaacagccuguccggcguggagggggagggccuccacaagcugggcuacauccugcgcgacaucagcaagauccccggcgggaacauguacgccgacgacaccgccgggugggacacgcggaucaccgaggacgaccuccagaacgaggccaagaucaccgacaucauggagcccgagcacgcccugcuggcgaccuccaucuucaagcucacguaccagaacaaggugguccgcgugcagcggcccgccaagaacgggaccgugauggacgucaucagccgccgcgaccagcggggcuccggccaggugggcaccuacgggcugaacaccuucacgaacauggaggugcagcugauccgccagauggagagcgagggcaucuuccuccccuccgagcuggagaccccgaaccuggccgagcggguccucgacuggcuggagaagcacggggccgagcgccugaagcggauggccaucagcggcgacgacugcguggugaagcccaucgacgaccgcuucgcgaccgcccucaucgcccugaacgacaugggcaagguccggaaggacaucccccagugggagcccuccaagggguggaacgacuggcagcaggucccguucugcagccaccacuuccaccagcugaucaugaaggacggccgcgagaucgugguccccugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccguccccguggacugggugcccacgagccgcaccaccugguccauccacgcccaccaccaguggaugaccaccgaggacaugcucagcgucuggaaccggguguggaucgaggagaacccguggauggaggacaagacgcacguguccagcugggaggagguccccuaccugggcaagcgcgaggaccaguggugcgggucccugaucggccucaccgcccgggccaccugggcgaccaacauccagguggccaucaaccaggugcgccgccugaucgggaacgagaacuaccuggacuacaugacgagcaugaagcgguucaagaacgaguccgaccccgagggcgcccucugguga

SEQ ID NO: 8843 - RNA, 9879 nt, Artificial Sequence
  derived and/or modified CDS sequence (opt1) from DENV-1__KC759167__SS-prME
agcgugaccaugcugcucaugcugaugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgcgacaagcggagcguggcccucgcgccccacgugggccuggggcuggagacgcggaccgagaccuggaugagcuccgagggcgccuggaagcagauccagcgggucgagaccugggcccuccgccacccgggguucacggugaucgcccuguuccuggcgcacgccaucggcaccagcgugacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcgauccugcggaagcucugcaucgaggccaagaucuccaacaccaccacggacagccgcugcccgacccagggcgaggcccccgagguggaggagcaggacgccaacuucgucugccggcgcaccuucguggaccggggcugggggaacggcugcgggcuguucggcaaggggucccugaucacgugcgccaaguucaagugcgugacgaagcucgagggcaagaucguccaguacgagaaccugaaguacagcgugaucgugaccguccacaccggcgaccagcaccagguggggaacgaguccaccgagcacggcacgaccgcgaccaucacgccccaggcccccaccacggagauccagcugaccgacuacggggcccucacccuggacugcagcccgcgcaccggccuggacuucaacgagaugguccuccugacgaugaaggagaaguccuggcuggugcacaagcagugguuccucgaccugccccugcccuggaccagcggggccagcaccucccaggagaccuggaaccggcaggaccuccuggugacguucaagaccgcccacgcgaagaagcaggaggucguggugcugggcagccaggagggcgccaugcacaccgcccucaccggggccacggagauccagaccuccggcaccaccacgaucuucgccgggcaccugaagugccgccugaagauggacaagcucacccugaagggcaugagcuacgucaugugcaccggguccuucaagcuggagaaggagguggcggagacccagcacggcacggugcucguccagaucaaguacgagggcaccgacgcccccugcaagaucccguucagcacccaggacgagaagggggugacccagaacggccggcugaucacggccaaccccaucgugaccgacaaggagaagcccgucaacaucgaggccaagcccccguucggggaguccugcaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucacgagcgucgggaagcuggugcaccagaucuucggcaccgccuacggggugcuguucuccggcgucagcuggaccaugaagaucgggaucggcgugcuccugaccuggcugggccucaacucccgcagcacgucccugagcaugaccugcaucgccguggggcuggucacccucuaccugggcgugauggugcaggccgacuccgggugcgucaucaacuggaagggccgggagcugaagugcgggagcggcaucuucgugaccaacgaggugcacacguggaccgagcaguacaaguuccaggcggacagccccaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccacguucaucaucgacgggccgaacacccccgagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagaccuggaagcucgcgcgggccagcuucaucgaggucaagaccugcaucuggcccaagucccacacccuguggagcaacggcgugcuggaguccgagaugaucaucccgaagaucuacgggggccccaucagccagcacaacuaccgccccggguacuucacgcagaccgccggcccguggcaccucgggaagcuggagcuggacuucgaccucugcgagggcaccaccguggucguggacgagcacugcggcaaccgggggcccucccugcgcacgaccaccgugaccggcaagaucauccacgaguggugcugccggagcugcacgccgccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcgcccuggcgguguuccuccugcugaucauggggcagcucaccuggaacgaccugauccgccugugcaucauggucggcgccaacgccagcgaccgcauggggaugggcaccacguaccucgcccugauggccaccuucaagaugcggcccauguucgcggugggccuccuguuccgcaagcugaccucccgggaggugcugcuccugaccaucgggcugagccucgucgccuccguggagcugcccaacagccuggaggagcucggcgacgggcuggccaugggcaucaugauccugaagcuccugacggacuuccagucccaccagcugugggccacccuccugagccugaccuucaucaagaccacguucucccuccacuacgcguggaagaccauggccaugguccugagcaucgugucccuguucccccucugccugagcaccaccucccagaagacgaccuggcugcccgugcuccugggcagccuggggugcaagccccucaccauguuccugaucgccgagaacaagaucuggggccgccgguccuggccccugaacgaggggaucauggccgucggcaucgugagcauccuccugagcucccugcucaagaacgacgugccgcuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggaccaugaagaucaaggacgaggagcgcgacgacacgcugaccauccugcucaaggccacccugcuggccguguccggcguguacccccucagcauccccgccacccuguucgucugguacuucuggcggaagaagaagcagcgcuccggggugcugugggacaccccguccccgcccgagguggagcgggcgguccucgacgacggcaucuaccgcaucaugcagcggggccugcuggggcgcucccaggugggcgugggggucuuccaggagaacguguuccacacgauguggcacgugacccggggcgccguccugauguaccaggggaagcgccucgagcccagcugggccuccgugaagaaggaccugaucagcuacggcggcggguggcggcugcagggcuccuggaacaccggggagggcgugcaggucaucgccguggagccggggaagaaccccaagaacgugcagaccgcccccggcacguucaagacccccgagggcgaggucggggcgaucgcccucgacuucaagccgggcaccagcgggucccccaucgugaaccgcgagggcaagaucgugggccuguacgggaacggcgucgugaccacgagcgggaccuacgugagcgccaucgcccaggcgaaggccucccaggagggcccccugccggagaucgaggacgaggucuuccggaagcgcaaccucaccaucauggaccugcaccccgggagcggcaagacccggcgcuaccugcccgccaucgugcgggaggccaucaagcgcaagcuccgcacgcugauccuggcccccacccggguggucgcguccgagauggccgaggcccucaagggcaugccgauccgcuaccagaccaccgccgucaagagcgaguacacggggaaggagaucguggaccugaugugccacgccaccuucaccaugcggcugcucucccccguccgcgugcccaacuacaacaugaucaucauggacgaggcgcacuucaccgaccccagcuccaucgccgcccggggcuacaucagcacgcgcguggggaugggcgaggccgccgcgaucuucaugaccgccaccccgcccggguccgucgaggccuucccccagagcaacgccgugauccaggacgaggagcgggacauccccgagcgcuccuggaacagcggcuacgaguggaucaccgacuucccgggcaagacggugugguucguccccuccaucaagagcgggaacgacaucgcgaacugccugcggaagaacggcaagcgcgugauccagcugucccggaagaccuucgacaccgaguaccagaagaccaagaacaacgacugggacuacguggucacgaccgacaucagcgagaugggggccaacuuccgcgccgaccgggugaucgacccccgccggugccucaagcccgugauccugaaggacggcccggagcgcgucauccuggccgggcccaugcccgugaccgucgccuccgcggcccagcggcgcggccggaucggccgcaaccacaacaaggagggggaccaguacaucuacaugggccagccccucaacaacgacgaggaccacgcccacuggaccgaggccaagaugcugcuggacaacaucaacacgccggaggggaucauccccgcccucuucgagcccgagcgcgagaaguccgcggccaucgacggcgaguaccggcugcgcggggaggcccggaagaccuacguggagcugaugcgccggggcgaccuccccguguggcuguccuacaaggucgccagcgagggcuuccaguacagcgaccgccggugguacuucgacggggagcgcaacaaccaggugcuggaggagaacauggacguggagaucuggaccaaggagggcgagcggaagaagcuccgcccgcgguggcuggacgcccgcaccuacuccgacccccuggcgcuccgggaguucaaggaguucgccgccgggcgccggagcgucuccggcgaccugauccuggagaucggcaagcucccccagcaccugacgcagcgcgcccagaacgcgcuggacaaccucgugaugcugcacaacagcgagcagggcgggcgggccuaccgccacgccauggaggagcugcccgacaccaucgagacccucaugcugcuggcccucaucgccgugcugaccgggggcgucacgcuguucuuccucuccgggcggggccugggcaagaccagcaucgggcugcucugcgugauggcguccagcgugcugcuguggauggccuccgucgagccgcacuggaucgccgccagcaucauccucgaguucuuccugauggugcugcucauccccgagcccgaccgccagcggaccccgcaggacaaccagcuggccuacguggucaucggccuccuguucaugauccugaccguggcggccaacgagauggggcugcucgagaccacgaagaaggaccugggcaucgggcacguggccgucggcaaccaccaccacgccgccaugcuggacguggaccuccaccccgcguccgccuggacccuguacgccguggccaccaccaucaucacgcccaugaugcgccacaccaucgagaacaccaccgccaacaucagccugacggcgaucgccaaccaggccgccauccucaugggccuggacaagggguggcccaucuccaagauggacaucggcgucccgcugcucgcgcuggggugcuacagccaggugaacccccugacccucaccgccgccgugcugaugcuggucgcccacuacgccaucaucggccccgggcuccaggcgaaggccacccgcgaggcccagaagcggacggccgccggcaucaugaagaaccccaccguggacggcaucguggcgaucgaccuggacccggucguguacgacgccaaguucgagaagcagcuggggcagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggcgaacaucuuccggggcuccuaccucgccggggccggccuggccuucagccugaugaagucccucgggggcgggcgccggggcaccggcgcgcagggggagacgcugggcgagaaguggaagcgccagcugaaccagcucuccaagcuggaguucaacagcuacaagcgguccgggaucauggaggucgaccgcagcgaggccaaggagggccugaagcgcggggagaccaccaagcacgccgugucccgcggcaccgccaagcuccggugguucguggagcgcaaccuggucaagcccgagggcaaggugaucgaccuggggugcggccgcggcggguggagcuacuacugcgccgggcugaagaaggugacggaggucaagggguacaccaagggcgggccgggccacgaggagcccauccccauggcgaccuacggguggaaccucgugaagcugcacuccggcaaggacguguucuucaucccgcccgagaagugcgacacccugcucugcgacaucggggagagcucccccaaccccacgaucgaggagggccgcacccugcggguccugaagaugguggagcccuggcuccgcggcaaccaguucugcaucaagauccugaaccccuacaugcccagcguggucgagacccuggagcagaugcagcggaagcacgggggcaugcucgugcgcaacccccugucccggaacagcacccacgagauguacuggguguccugcgggacgggcaacaucgucagcgccgugaacaugaccucccgcaugcugcucaaccgcuucaccauggcccaccggaagcccaccuacgagcgcgacguggaccugggcgccgggacccggcacgucgccguggagccggagguggcgaaccuggacaucaucggccagcgcaucgagaacaucaagcacgagcacaagagcacguggcacuacgacgaggacaaccccuacaagaccugggccuaccacggguccuacgaggucaagcccagcggcuccagcagcuccauggugaacggggucgugaagcuccugaccaagcccugggacgugaucccgauggucacccagaucgccaugacggacaccacccccuucggccagcagcggguguucaaggagaagguggacacccgcacgcccaaggccaagcggggcaccgcccagaucauggaggucaccgcgaaguggcuguggggguuccucagccgcaacaagaagccgcggaucugcacccgcgaggaguucacgcggaaggugcgcuccaacgccgccaucggcgccguguucgucgacgagaaccaguggaacagcgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaagggcucccgggccaucugguacauguggcugggggcgcgcuuccuggaguucgaggcccucggcuucaugaacgaggaccacugguucagccgggagaacucccugagcgggguggagggcgaggggcugcacaagcucggcuacauccugcgcgacaucuccaagauccccggcgggaacauguacgccgacgacaccgccggcugggacacccggaucacggaggacgaccugcagaacgaggcccgcaucaccgacaucauggagcccgagcacgcgcuccuggccaagagcaucuucaagcugaccuaccagaacaaggugguccgcgugcagcggcccgccaagaacgggaccgugauggacgucaucucccgccgggaccagcgcggcagcggccagguggggacguacggccucaacaccuucaccaacauggaggcccagcugauccggcagauggaguccgaggagaucuucagcccguccgagcuggagacccccaaccucgccgagcgcgugcuggacuggcuggagaaguacgggaucgagcggcucaagcgcauggcgaucagcggcgacgacugcgucgugaagcccaucgacaaccgguucgccacggcccugaccgcccugaacgacauggggaaggugcgcaaggacaucccccagugggagccguccaagggcuggaacgacuggcagcaggucccccucugcagccaccacuuccaccagcugaucaugaaggacggccgggagaucguggugcccugccgcaaccaggacgagcuggucgggcgggcccgcgugagccagggcgcgggguggucccuccgggagaccgccugccugggcaagagcuacgcccagauguggcagcugauguacuuccaccgccgggaccuccgccuggccgcgaacgccaucugcuccgccgugcccgucgacuggaucccgaccagccggacgaccugguccauccacgcccaccaccaguggaugaccaccgaggacaugcugagcguguggaaccgcguguggaucgaggagaaccccuggauggaggacaagacgcacaucuccagcuggggcgacguccccuaccucggcaagcgcgaggaccaguggugcggcucccugaucgggcugaccgcccgggcgaccugggccaccaacauccagguggccaucaaccaggugcgccggcucaucggcaacgagaacuaccuggacuacaugacgagcaugaagcgcuucaagaacgaguccgaccccgagggggcccugugguga

SEQ ID NO: 8844 - RNA, 9879 nt, Artificial Sequence
  derived and/or modified CDS sequence (opt1) from DENV-1__JQ048541__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcggagcguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuuccugacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccgucgggaagcucgugcaccagaucuucggcaccgccuacggggugcuguucagcggcgucuccuggaccaugaagaucgggaucggcgugcugcucacguggcugggccugaacagccgcuccaccagccucuccaugaccugcaucgccguggggcuggucacccuguaccucggcgugauggugcaggccgacagcgggugcgucaucaacuggaagggccgggagcugaagugcggguccggcaucuucgugacgaacgaggugcacaccuggaccgagcaguacaaguuccaggcggacagcccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucaccgugguggucggggacguggcgggcauccuggcccaggggaagaagaugauccggccccagcccauggagcacaaguacuccuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacgcucugguccaacggcgugcuggagagcgagaugaucauccccaagaucuacgggggcccgaucucccagcacaagcugcgccccggguacuucacccagaccgccggccccuggcaccucgggaagcuggagcuggacuucgaccucugcgagggcaccacgguggucguggacgagcacugcggcaaccgggggccgagccugcgcaccaccaccgugacgggcaagaucauccacgaguggugcugccgguccugcacccugccgccccugcgcuuccgcggggaggacggcugcugguacgggauggagauccgccccgucaaggagaaggaggagaaccuggucaagagcaugguguccgccggcagcggcgaggucgacagcuucucccuggggcuccugugcaucagcaucaugaucgaggaggugaugcggucccgcuggagccggaagaugcugaugaccggcacccucgccguguucuuccugcugaucauggggcagcucacguggaacgaccugauccgcuccugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccaccaugcuggacguggaccugcaccccgccuccgccuggacgcucuacgcgguggccaccaccaucaucaccccgaugaugcggcacacgaucgagaacaccaccgccaacaucagccugaccgccaucgccaaccaggcggccauccugauggggcucgacaagggcuggcccaucuccaagauggacaucggcgucccccugcuggcccucgggugcuacagccaggugaacccccugacgcugaccgccgcggugcucaugcuggucgcccacuacgccaucaucggcccggggcugcaggccaaggccacccgcgaggcgcagaagcgcaccgccgccggcaucaugaagaaccccacgguggacgggaucguggccaucgaccucgaccccgucguguacgacgccaaguucgagaagcagcugggccagaucaugcugcucauccugugcaccucccagauccugcucaugcggaccaccugggcgcugugcgagagcaucacgcuggccaccggcccccucaccacccugugggagggguccccgggcaaguucuggaacacgaccaucgccgugagcauggccaacaucuuccgcggguccuaccuggccggcgcgggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggaggucgaccggagcgaggccaaggagggccucaagcgcggggagaccaccaagcacgcggugucccggggcaccgccaagcugcgcugguucguggagcggaaccuggucaagcccgaggggaaggugaucgaccugggcugcggccgcgggggcuggagcuacuacugcgccgggcucaagaaggugacggaggucaagggcuacaccaagggcggccccggccacgaggagcccaucccgauggccaccuacggguggaaccuggugaagcuguacuccggcaaggacguguucuucaugccgcccgagaagugcgacacccuccugugcgacaucggggagagcucccccaacccgacgaucgaggagggccggacccugcgcguccucaagaugguggagcccuggcugcgggggaaccaguucugcaucaaggugcugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgccgugaacaugacgucccggaugcuccugaaccgcuucaccauggcgcaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccgcccagaucauggaggugaccgcccgguggcucuggggcuuccugucccgcaacaagaagccccggaucugcacccgcgaggaguucacgcggaaggugcgcagcaacgcggccaucggcgccgucuucaucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaaggugguccgcgugcagcgccccgccaagaacgggaccgugauggacgucaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcgggugcuggacuggcucgagaaguacggcgucgagcgccugaagcggauggcgaucagcggggacgacugcguggugaagccgaucgacgaccgcuucgccacggcccugaccgcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugucccagggggcgggcugggggcuccgcgagaccgccugccugggcaagagcuacgcccagauguggcagcugauguacuuccaccggcgcgaccuccggcuggccgcgaacgccaucugcagcgccguccccguggacugggugcccaccucccgcacgaccuggagcauccacgcccaccaccaguggaugaccaccgaggacaugcuguccgucuggaaccggguguggaucgaggagaaccccuggauggaggacaagacgcacaucagcuccugggaggacgugccguaccucgggaagcgcgaggaccaguggugcggcagccugaucggccugaccgcccgcgcgaccugggccaccaacauccaggucgccaucaaccaggugcggcgccucaucgggaacgagaacuaccuggacuacaugaccuccaugaagcgguucaagaacgagagcgaccccgagggcgcccugugguga

SEQ ID NO: 8845 - RNA, 9879 nt, Artificial Sequence
  derived and/or modified CDS sequence (opt1) from DENV-1__JN697056__SS-prME
agcgugaccaugcugcucaugcugcugcccaccgcccucaccuuccaccugaccacccggggcggggagccccacaugaucgugagcaagcaggagcggggcaagagccuccucuucaagaccagcgccggggugaacaugugcacccugaucgcgauggaccugggcgagcucugcgacgacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccuggcgccccacaucggccuggggcucgagacccgcaccgagacguggaugagcagcgagggcgccuggcggcagauccagaagguggagaccugggcgcugcgccaccccggguucaccgugaucgcccuguuccucgcccacgccaucggcaccagcaucacgcagaaggggaucaucuucauccugcugaugcucgugacccccuccauggcgaugcggugcgugggcaucggcaaccgcgacuucguggaggggcugagcggcgccaccuggguggacgugguccuggagcacggguccugcgugaccacgauggccaaggacaagcccacccucgacaucgagcugcugaagaccgaggugaccaaccccgccguccuccggaagcugugcaucgaggccaagaucagcaacacgaccaccgacucccgcugcccgacccagggcgaggcgacgcugguggaggagcaggacaccaacuucgugugccggcgcaccuucgucgaccggggcugggggaacggcugcggccucuucggcaaggggagccugaucacgugcgccaaguucaagugcgugacgaagcuggagggcaagaucgugcaguacgagaaccucaaguacuccgucaucgugaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcugguccacaagcagugguuccuggaccucccccugcccuggacguccggggcgagcaccagccaggagaccuggaaccggcaggaccugcucgugaccuucaagacggcccacgccaagaagcaggagguggucgugcugggcucccaggagggcgccaugcacaccgcccugaccggggcgaccgagauccagacgagcggcaccaccaccaucuucgccgggcaccucaagugccgccugaagauggacaagcugacgcucaagggcaucuccuacgugaugugcaccgggcccuucaagcuggagaaggaggucgccgagacccagcacggcaccgugcuggugcaggucaaguacgagggcacggacgcccccugcaagaucccguucagcucccaggacgagaagggggugacccagaacggccggcuggugaccgccaaccccaucgucaccgacaaggagaagcccgugaacaucgaggcggagcccccguucggggagagcuacaucguggucggcgccggcgagaaggcccucaagcuguccugguucaagaaggggagcuccaucggcaagauguucgaggccacggcgcgcggggcccggcgcauggccauccugggcgacaccgccugggacuucgggagcaucggcggcguguucaccuccguggggaagcucguccaccagaucuucggcaccgccuacggggugcuguucagcggcguguccuggacgaugaagaucgggaucggcauccugcucaccuggcugggccugaacagccgcuccaccagccucuccaugaccugcaucgcggucgggaugaucacgcuguaccugggcgugauggugcaggccgacagcgggugcgucaucaacuggaagggccgggagcucaagugcggguccggcaucuucgugaccaacgaggugcacaccuggaccgagcaguacaaguuccaggccgacagccccaagcgccugagcgccgccaucggcaaggcgugggaggagggggucugcggcauccgguccgccacccgccuggagaacaucauguggaagcagaucagcaacgagcucaaccacauccugcuggagaacgacaugaaguucacggugguggucggggacguguccggcauccucgcccaggggaagaaguccauccggccccagcccauggagcacaaguacuccuggaaguccuggggcaaggccaagaucaucggcgccgacgugcagaacaccaccuucaucaucgacgggccgaacacccccgagugccccgacgaccagcgcgcguggaacaucugggaggucgaggacuacggcuucgggaucuucacgaccaacaucuggcugaagcugcgggacuccuacacccaggugugcgaccaccgccucaugagcgccgccaucaaggacuccaaggccgugcacgcggacaugggcuacuggaucgagagcgagaagaacgagaccuggaagcuggcccgggccuccuucaucgaggucaagacgugcaucuggcccaagagccacacccugugguccaacggcgugcucgagagcgagaugaucaucccgaagaucuacgggggccccaucucccagcacaacuaccgccccggguacuucacccagaccgccggcccguggcaccuggggaagcuggagcucgacuucgaccugugcgagggcacgaccguggucguggacgagcacugcggcaaccgggggcccagccugcgcaccaccacggugaccggcaagaucauccacgaguggugcugccgguccugcacccugccgccccugcgcuucaagggggaggacggcugcugguacgggauggagauccggccggucaaggagaaggaggagaaccuggucaagagcauggugagcgccggcuccggcgaggucgacagcuucucccucgggcugcugugcaucagcaucaugaucgaggaggugaugcgcucccgguggagcaagaagaugcucaugaccggcacgcuggcgguguuccugcuccugaccauggggcagcugaccuggaacgaccucauccgccugugcaucauggucggcgccaacgccuccgacaacauggggaugggcaccacguaccuggcccucauggccaccuuccggaugcgccccauguucgccguggggcugcuguuccgccggcucaccagccgcgaggugcugcugcucaccgucgggcugucccugguggccagcgucgagcuccccaacucccuggaggagcugggcgacgggcucgccaugggcaucaugauccugaagcugcucacggacuuccagagccaccagcugugggccacccugcucucccugaccuucgugaagaccacguucagccugcacuacgccuggaagaccauggcgaugauccucuccaucgugagccugcugccccucugccuguccaccaccagccagaagacgaccuggcugccgguccuccugggcucccuggggugcaagccccucaccauguuccugaucaccgagaacaagaucuggggccgcaagagcuggccccugaacgaggggaucauggccgugggcaucgugagcauccuccuguccagccugcucaagaacgacgucccccuggccgggccgcugaucgccggcggcaugcucaucgcgugcuacgugaucuccgggagcuccgccgaccugagccuggagaaggccgccgagguguccugggaggaggaggccgagcacagcggcgcgucccacaacauccucgucgagauccaggacgacgggaccaugaagaucaaggacgaggagcgcgacgacacgaucaccauccugcugaaggccacccuccuggccaucagcggcguguaccccauguccauccccgccacccuguucgugugguacuucuggcagaagcggaagcagcgcagcgggguccucugggacacgcccuccccgcccgagguggagcgggccgugcuggacgacggcaucuaccgcauccugcagcggggccugcucgggcgcagccaggucggcguggggguguuccaggagggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaacccgaagaacgugcagacggcccccggcaccuucaagaccuccgagggcgaggugggggccaucgcgcuggacuucaagcccggcaccagcgggagccccaucgucaaccgcgagggcaagaucgugggccuguacgggaacggcguggucacgaccuccgggaccuacgugagcgccaucgcccaggccaaggccucccaggagggcccgcuccccgagaucgaggacgagguguuccggaagcgcaaccugaccaucauggaccugcaccccgggagcggcaagacgcggcgcuaccucccggcgaucguccgggaggccaucaagcgcaagcugcggacccuggugcucgcccccacccgcguggucgccuccgagauggcggaggcccugaagggcaugcccauccgcuaccagaccacggccgucaagagcgagcacaccgggcgggagaucguggaccugaugugccacgccaccuucaccaugcgccuccugucccccguccgggugccgaacuacaacaugaucaucauggacgaggcccacuucacggaccccgcgagcaucgccgcccgcggcuacaucuccacccggguggggaugggcgaggccgccgcgaucuucaugaccgccacgccgcccgggagcgucgaggccuucccgcaguccaacgccgugauccuggacgaggagaaggacauccccgagcgcagcuggaacuccggcuacgacuggaucacggacuuccccggcaagaccgugugguucguccccagcaucaaguccgggaacgacaucgccaacugccuccggaagaacggcaagcgcgugauccagcugagccggaagaccuucgacaccgaguaccagaagacgaagaacaacgacugggacuacguggucaccaccgacaucuccgagaugggggcgaacuuccgcgccgaccgggugaucgacccgcgccggugccugaagcccgugauccucaaggacggccccgagcgcgucauccuggccgggcccaugccggugaccgucgccagcgcggcccagcggcgcggccggaucggccgcaaccagaacaaggagggggaccaguacaucuacaugggccagccccugaacaacgacgaggaccacgcccacuggacggaggccaagaugcuccuggacaacaucaacacccccgaggggaucauccccgcccuguucgagccggagcgggagaaguccgcggccaucgacggcgaguaccgccuccgcggggaggcccggaagaccuucguggagcugaugcgccggggcgaccugcccguguggcucagcuacaaggucgccagcgagggcuuccaguacuccgaccgccgguggugcuucgacggggagcgcaacaaccaggugcuggaggagaacauggacguggagaucuggaccaaggagggcgagcggaagaagcugcgcccccgguggcucgacgcccgcacguacagcgacccccuggcgcugcgggaguucaaggaguucgccgccgggcgccgguccgucagcggcgaccucauccuggagaucggcaagcugccgcagcaccucacccagcgcgcccagaacgcccuggacaaccuggugaugcuccacaacuccgagcagggcgggaaggcguaccggcacgccauggaggagcugcccgacaccaucgagacccugaugcuccuggcccugaucgccgugcucaccgggggcgucacgcuguucuuccugagcgggcgcggccucggcaagaccuccaucgggcugcugugcgugaugagcuccagcgcgcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgcggccaacgagauggggcugcuggagacgaccaagaaggaccucggcaucgggcacgccgccgccgagaaccaccaccacgcggccaugcuggacguggaccugcaccccgccuccgccuggacccucuacgccguggcgaccacgaucaucaccccgaugaugcggcacaccaucgagaacaccacggccaacaucagccugaccgccaucgccaaccaggccgcgauccugaugggccucgacaagggcuggcccaucuccaagauggacaucggggucccccugcuggcccucggcugcuacagccaggugaacccccugacccugaccgccgccgugcucaugcuggucgcgcacuacgccaucaucgggccgggccugcaggccaaggccacgcgcgaggcccagaagcggaccgcggccgggaucaugaagaaccccaccguggacggcaucguggccaucgaccucgaccccgucguguacgacgccaaguucgagaagcagcugggccagaucaugcugcucauccugugcaccucccagauccugcucaugcgcacgaccugggcccugugcgagagcaucacccuggcgaccgggccccucacgacccugugggagggcuccccggggaaguucuggaacaccaccaucgccgugagcauggccaacaucuuccgcggcagcuaccuggccggcgccgggcucgcguucucccugaugaagucccugggcgggggccggcgcgggacgggcgcccagggcgagacccucggggagaaguggaagcggcagcugaaccagcuguccaagagcgaguucaacaucuacaagcgcuccggcaucgucgagguggaccggagcgaggccaaggaggggcucaagcgcggcgagaccaccaagcacgccgugucccgggggacggcgaagcugcgcugguucgucgagcggaaccuggugaagcccgagggcaaggugaucgaccugggcugcgggcgcggcggguggagcuacuacugcgccggccucaagaaggucaccgaggugaagggguacaccaagggcggccccgggcacgaggagcccaucccgauggccaccuacggcuggaaccuggugaagcuguacuccgggaaggacgucuucuucaucccgcccgagaagugcgacacgcuccugugcgacaucggcgagagcucccccaacccgaccaucgaggaggggcggacccugcgcgugcucaagaugguggagcccuggcugcggggcaaccaguucugcaucaagauccugaaccccuacaugcccagcgucguggagacccucgagcagaugcagcgcaagcacggcgggaugcuggugcggaacccgcugucccgcaacagcacccacgagauguacugggucuccugcggcacggggaacaucgugagcgccgugaacaugaccucccggaugcuccugaaccgcuucaccauggcccaccggaagcccaccuacgagcgcgacgucgaccugggcgcgggcacgcgccacguggccguggagcccgaggucgccaaccucgacaucaucgggcagcggaucgagaacaucaagaacgagcacaagagcaccuggcacuacgacgaggacaaccccuacaagaccugggccuaccacggcuccuacgaggugaagccgagcgggagcgccuccagcauggugaacggcgucgugcgccugcugaccaagcccugggacgucauccccauggugacgcagaucgcgaugaccgacaccacccccuucgggcagcagcggguguucaaggagaaggucgacacgcgcaccccgaaggccaagcggggcaccgcccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacuccgccaaggaggccguggaggacgagcgguucugggaccugguccgccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgcggacgacaccgccgggugggacacgcgcaucaccgaggacgaccuccagaacgaggccaagaucaccgacaucauggagccggagcacgcccugcuggccaccuccaucuucaagcucacguaccagaacaaggucgugcgggugcagcgccccgcgaagaacggcaccgucauggacgugaucagccgccgggaccagcgcggguccggccaggugggcaccuacgggcugaacaccuucacgaacaugggcgcccagcugauccggcagauggagagcgaggggaucuuccuccccuccgagcuggagacccccaaccuggccggccgcguccucgacuggcuggagaagcacgggaucgagcggcugcgccggauggccaucagcggcgacgacugcguggugaagccgaucgacgaccgcuucgccaccgcgcucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucguggggcgcgcccgggugagccagggcgccggguggucccugcgcgagacggccugccugggcaagagcuacgcgcagauguggcagcucauguacuuccaccggcgcgaccugcggcuggccgccaacgccaucugcuccgcgguccccguggacugggugcccaccagccgcaccaccugguccauccacgcccaccaccaguggaugacgaccgaggacaugcucagcgucuggaaccggguguggaucgaggagaaccccuggauggaggacaagacccacguguccagcugggaggacgucccguaccugggcaagcgcgaggaccaguggugcgggucccugaucggccucaccgcccgcgccaccugggccacgaacauccagguggcgaucaaccaggugcggcgccugaucgggaacgagaacuaccuggacuacaugaccagcaugaagcgguucaagaacgaguccgaccccgagggcgcccucugguga

SEQ ID NO: 8846 - RNA, 9879 nt, Artificial Sequence
  derived and/or modified CDS sequence (opt1) from DENV-1__JN697057__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaucugcacccucaucgccauggaccugggcgagcugugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaaggugagcugguucaagaagggguccagcaucggcaagauguucgaggccaccgcccgcggggcccggcgcauggcgauccucggcgacacggccugggacuucggguccaucggcggcgucuucaccagcguggggaagcuggugcaccagaucuucggcaccgccuacgggguccuguucuccggcgugagcuggaccaugaagaucgggaucggcgugcuccugacguggcugggccucaacucccgcagcaccucccugagcaugaccugcaucgccgucgggcuggugacccucuaccugggcgugaugguccaggccgacuccgggugcgugaucaacuggaagggccgggagcugaagugcgggagcggcaucuucgugacgaacgagguccacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccguggucgugggggacguggcgggcauccuggcccaggggaagaagaugauccggccccagcccauggagcacaaguacagcuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcucaagcugcgggacagcuacacccaggugugcgaccaccgccugauguccgccgccaucaaggacagcaaggccguccacgccgacaugggcuacuggaucgaguccgagaagaacgagaccuggaagcucgcgcgggccagcuucaucgaggugaagaccugcaucuggcccaagucccacacgcuguggagcaacggcgugcuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggucgugguggacgagcacugcggcaaccgggggccgucccugcgcaccaccaccgucacgggcaagaucauccacgaguggugcugccggagcugcacccugccgccccugcgcuuccgcggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcuggucccggaagaugcugaugaccggcacccucgccgucuucuuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccgugggccuccuguuccgccggcugacgucccgcgagguccugcuccugaccaucgggcugagccucguggcguccgucgagcugcccaacagccuggaggagcucggcgacgggcuggccaugggcaucaugauccugaagcuccugaccgacuuccagucccaccagcugugggugacccuccugagccugacguucaucaagaccgccuucucccuccacuacgccuggaagaccauggcgauggugcugagcaucgucucccuguucccccucugccugagcaccacgucccagaagaccaccuggcugcccgugcuccugggcagccuggggugcaagccgcucaccauguuccugaucgccgagaacaagaucuggggccggaaguccuggccccugaacgaggggaucauggccgugggcaucgucagcauccuccugagcucccugcucaagaacgacgugccccuggccgggccccugaucgccggcggcaugcucaucgcgugcuacgugaucagcggguccagcgccgaccugucccuggagaaggccgccgaggucagcugggaggaggaggccgagcacuccggcgcgagccacaacauccucguggaggugcaggacgacgggacgaugaagaucaaggacgaggagcgcgacgacacccugaccauccugcucaaggccacccugcuggccgucuccggcguguacccgcucagcauccccgccacccuguucgugugguacuucuggcagaagaagaagcagcgguccgggguccugugggacacgcccagcccgcccgagguggagcgcgccgugcucgacgacggcaucuaccggaucaugcagcgcggccugcuggggcggucccaggucggcguggggguguuccaggagaacgucuuccacaccauguggcacgugacccgcggcgcggugcugauguaccaggggaagcggcucgagcccagcugggccuccgucaagaaggaccugaucagcuacggcggcggguggcgccugcagggcuccuggaacaccggggaggagguccaggugaucgccgucgagcccggcaagaaccccaagaacgugcagacggcccccgggaccuucaagacccccgagggcgaggugggcgccaucgcgcucgacuucaagcccgggaccagcggcucccccaucgucaaccgggagcgcaagaucguggggcuguacggcaacggcguggucacgaccagcgggaccuacgugagcgccaucgcccaggccaaggcgucccaggagggcccgcugcccgagaucgaggacgagguguuccggaagcgcaaccucaccaucauggaccugcaccccgggagcggcaagacgcggcgcuaccugccggccaucguccgggaggccaucaagcgcaagcuccgcacccugauccuggcccccacccgggugguggccuccgagauggcggaggcccucaaggggaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucacggacuuccccgggaagaccgugugguucgugcccuccaucaagagcggcaacgacaucgccaacugccugcggaagaacggcaagcgcgucauccagcugucccggaagaccuucgacaccgaguaccagaagacgaagaacaacgacugggacuacguggugaccaccgacaucagcgagaugggggcgaacuuccgcgccgaccgggucaucgacccgcgccggugccucaagcccgugauccugaaggacggccccgagcgcgucauccuggccgggcccaugccggugaccguggccuccgccgcgcagcggcgcggccggaucgggcgcaaccacaacaaggagggcgaccaguacaucuacaugggccagccccucaacaacgacgaggaccacgcccacuggacggaggccaagaugcugcuggacaacaucaacacccccgaggggaucauccccgcccucuucgagccggagcgcgagaaguccgccgcgaucgacggcgaguaccggcugcgcggggaggcccggaagaccuucgucgagcugaugcgccggggcgaccuccccguguggcuguccuacaagguggccagcgagggguuccaguacagcgaccgccgguggugcuucgacggcgagcgcaacaaccagguccuggaggagaacauggacguggagaucuggaccaaggagggcgagcggaagaagcuccgcccccgguggcuggacgcccgcacguacuccgacccccuggcccuccgggaguucaaggaguucgcggccgggcgccggagcguguccggcgaccugauccuggagaucgggaagcucccgcagcaccugacccagcgcgcccagaacgcccuggacaaccucgucaugcugcacaacagcgagcagggcggccgggcguaccgccacgccauggaggagcugcccgacaccaucgagacccucaugcugcuggcccucaucgccgugcugaccgggggcgugacccuguucuuccucuccgggcggggccuggggaagaccagcaucggccugcucugcgucauggccuccagcgugcugcuguggauggcguccguggagccccacuggaucgccgccagcaucauccucgaguucuuccugaugguccugcucauccccgagccggaccgccagcggacgccccaggacaaccagcuggccuacguggugaucggccuccucuucaugauccugaccgucgccgcgaacgagauggggcugcucgagacgaccaagaaggaccugggcaucgggcacguggccguggagaaccaccaccacgccgccaugcuggacgucgaccuccaccccgccuccgcguggacccuguacgccguggccaccacgaucaucaccccgaugaugcgccacaccaucgagaacaccacggccaacaucagccugaccgccaucgcgaaccaggccgccauccucaugggccuggacaagggguggcccaucuccaagauggacaucggcgugccccugcucgcccugggcugcuacagccaggucaacccccugacccucaccgcggccgugcugaugcuggccgcccacuacgccaucaucgggccgggccuccaggcgaaggccacgcgcgaggcccagaagcggaccgccgccgggaucaugaagaaccccaccguggacggcaucgucgcgaucgaccuggaccccgugguguacgacgccaaguucgagaagcagcuggggcagaucaugcuccugauccugugcaccucccagauccuccugaugcgcacgaccugggcccugugcgagagcaucacccucgccaccggcccccugacgacccugugggagggcuccccggggaaguucuggaacaccaccaucgccgucagcauggcgaacaucuuccggggcuccuaccucgccggggccggccuggccuucagccugaugaagucccucggcgggggccgccgggggacgggcgcgcagggggagacccugggcgagaaguggaagcgccagcugaaccagcucuccaagagcgaguucaacaccuacaagcgguccggcaucauggagguggaccgcagcgaggccaaggaggggcugaagcggggcgagaccacgaagcacgccgugucccgcgggaccgccaagcugcggugguucgucgagcgcaaccucgugaagcccgagggcaagguggucgaccuggggugcggccggggcggguggagcuacuacugcgccggccugaagaaggugaccgaggugaagggguacaccaagggcgggcccggccacgaggagcccaucccgauggcgacguacggcuggaaccuggucaagcuccacuccgggaaggacguguucuucaucccgcccgagaagugcgacacccugcugugcgacaucggcgagagcucccccaacccgaccaucgaggaggggcgcacccuccgggugcugaagauggucgagcccuggcugcgcggcaaccaguucugcaucaagauccucaaccccuacaugcccagcgugguggagacgcuggagcagaugcagcggaagcacgggggcaugcugguccgcaacccgcucucccggaacagcacccacgagauguacuggguguccugcggcaccgggaacaucgugagcgccgucaacaugaccucccgcaugcugcugaaccgcuucaccauggcccaccggaagcccacguacgagcgcgacguggaccucggcgccgggacccggcacguggccgucgagcccgagguggcgaaccuggacaucaucggccagcgcaucgagaacaucaagcacgagcacaagagcaccuggcacuacgacgaggacaaccccuacaagaccugggccuaccacggcuccuacgaggucaagccgagcggguccgccagcagcauggugaacggcguggucaagcugcucacgaagcccugggacgugauccccauggugacccagaucgccaugaccgacaccacgcccuucgggcagcagcgggucuucaaggagaagguggacacccgcaccccgaaggccaagcggggcaccgcgcagaucauggaggugacggcccgcuggcuguggggguuccugucccggaacaagaagccccgcaucugcacccgggaggaguucacccgcaagguccggagcaacgccgccaucggcgcgguguucguggacgagaaccaguggaacuccgccaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcagccgcgcgaucugguacauguggcucggggcccgguuccuggaguucgaggcccugggcuucaugaacgaggaccacugguucucccgcgagaacagccucuccggcgucgagggggagggccugcacaagcugggguacauccuccgggacaucagcaagauccccggcgggaacauguacgccgacgacacggccggcugggacacccgcaucaccgaggacgaccugcagaacgaggcgaagaucaccgacaucauggagccgaagcacgcccugcucgccaaggccaucuucaagcugacguaccagaacaagguggugcgcguccagcggcccgccaagaacggcaccgugauggacgugaucucccgccgggaccagcgcgggagcggccaggucgggaccuacggccugaacaccuucacgaacauggaggcgcagcucauccggcagauggaguccgagggcaucuucagccccuccgagcuggagacccccaaccuggccgagcgcgugcucgacuggcuggagaaguacgggguggagcggcugaagcgcauggccaucagcggcgacgacugcgucgugaagccgaucgacgaccgguucgccaccgcccucaccgcgcugaacgacauggggaaggugcgcaaggacaucccccagugggagcccuccaagggcuggaacgacuggcagcagguccccuucugcagccaccacuuccaccagcugaucaugaaggacgggcgggagaucguggugccgugccgcaaccaggacgagcucgucggccgggcccgcgugucccagggcgccggguggagccugcgggagacggccugccugggcaagagcuacgcgcagauguggcagcucauguacuuccaccgccgggaccugcgccuggccgccaacgccaucugcuccgccgugcccgucgacugggugcccaccagccggaccaccugguccauccacgcgcaccaccaguggaugacgaccgaggacaugcucagcguguggaaccgcgucuggaucgaggagaaccccuggauggaggacaagacccacaucuccagcugggaggacgugccguaccuggggaagcgcgaggaccaguggugcggcucccugaucgggcucaccgcccgggccacgugggccaccaacauccagguggccaucaaccagguccgccggcugaucggcaacgagaacuaccuggacuacaugaccagcaugaagcgcuucaagaacgaguccgaccccgagggcgcgcucugguga

SEQ ID NO: 8847 - RNA, 9879 nt, Artificial Sequence
  derived and/or modified CDS sequence (opt1) from DENV-1__HQ624984__SS-prME
agcgugaccaugcugcucaugcugaugcccaccgcccuggccuuccaccucacgacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagagcgccuggaagcagauccagcggguggagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugcccgacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccgcuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuucuccacccaggacgagaagggcgucacgcagaacgggcggcugaucaccgccaacccgaucgugaccgacaaggagaagcccgugaacaucgaggccgagccgcccuucggcgagagcuacaucgucaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgugggcaagcugguccaccagaucuucgggaccgccuacggcguccuguucagcgggguguccuggaccaugaagaucggcaucgggguccugcugacguggcucggccugaacagccgcuccaccagccuguccaugaccugcaucgccgugggccucgugacccuguaccugggggucauggugcaggccgacagcggcugcgugaucaacuggaaggggcgggagcucaagugcggcagcgggaucuucgucacgaacgaggugcacaccuggaccgagcaguacaaguuccaggcggacuccccgaagcgccugagcgccgccaucggcaaggccugggaggagggcgugugcgggauccgguccgccacccgccuggagaacaucauguggaagcagaucagcaacgagcucaaccacauccugcuggagaacgacaugaaguucaccgucguggugggcgacgucgcggggauccucgcccagggcaagaagaugauccggccccagcccauggaguacaaguacuccuggaaguccugggggaaggccaagaucaucggcgccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacuccuacacccaggucugcgaccaccgccucaugagcgccgccaucaaggacuccaaggccgugcacgccgacaugggguacuggaucgagagcgagaagaacgagaccuggaagcuggcgcgggccuccuucaucgaggugaagaccugcaucuggcccaagagccacacgcugugguccaacggcguccucgagagcgagaugaucauccccaagaucuacggcgggccgaucucccagcacaacuaccgccccggcuacuucacccagaccgccgggcccuggcaccugggcaagcuggagcucgacuucgaccugugcgaggggaccacggugguggucgacgagcacugcggcaaccggggcccgagccugcgcaccaccaccgugacggggaagaucauccacgaguggugcugccgguccugcacccugccgccccuccgcuuccggggcgaggacgggugcugguacggcauggagauccgccccgugaaggagaaggaggagaaccuggucaagagcauggugagcgccggguccggcgagguggacagcuucucccucggccugcugugcaucagcaucaugaucgaggaggucaugcggucccgcuggagccggaagaugcucaugaccgggacccuggccguguuccugcuccugaucaugggccagcugacguggaacgaccucauccgccugugcaucauggugggggcgaacgccuccgaccgcaugggcauggggaccaccuaccuggcccucauggccaccuucaagaugcggccgauguucgccgucggccugcuguuccgccggcucacgagccgcgaggugcugcugcucaccaucggccugucccugguggcgagcgucgagcuccccaacucccuggaggagcugggggacggccucgccauggggaucaugauccugaagcugcucaccgacuuccagagccaccagcugugggccacccugcucucccugacguucaucaagaccaccuucagccugcacuacgccuggaagaccauggcgauggugcucuccaucgucagccuguucccccugugccucuccacgaccagccagaagaccaccuggcugcccgugcugcucggcucccugggcugcaagccgcugacgauguuccucaucgccgagaacaagaucugggggcggcgcagcuggccccugaacgagggcaucauggccguggggaucgucagcauccugcucuccagccugcugaagaacgacgugccccucgccggcccccugaucgccgggggcaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgggacgacacccucaccauccugcugaaggccacccuccuggccgucagcgggguguacccgcuguccauccccgccacccucuucgugugguacuucuggcagaagaagaagcagcgcagcggcguccugugggacacccccagcccgcccgagguggagcgggccgugcuggacgacgggaucuaccgcaucaugcagcggggccugcucggccgcagccaggucggggugggcguguuccaggagaacgucuuccacaccauguggcacgugacccgcggggccgugcugauguaccagggcaagcgccuggagcccuccugggccagcgucaagaaggaccucaucuccuacgggggcggcuggcggcugcaggggagcuggaacacgggcgaggagguccaggugaucgccgucgagcccgggaagaaccccaagaacgugcagaccgcccccggcaccuucaagaccuccgagggggaggugggcgccaucgcgcuggacuucaagcccggcacgagcgggagccccaucgucaaccgcgagggcaagaucguggggcucuacggcaacggcguggucaccaccuccgggaccuacgugagcgccaucgcccaggccaaggcgucccaggagggcccccugccggagaucgaggacgagguguuccggaagcgcaaccugacgaucauggaccuccaccccgggagcggcaagacccggcgcuaccugcccgccaucguccgggaggccaucaagcgcaagcugcgcacccucauccuggccccgacccgggugguggccuccgagauggcggaggcccugaaggggaugcccauccgcuaccagacgaccgccgucaagagcgagcacaccggcaaggagaucguggaccucaugugccacgccaccuucacgaugcggcugcugucccccgugcgcguccccaacuacaacaugaucaucauggacgaggcccacuucaccgacccgagcuccaucgcggcccggggcuacaucagcacccgcguggggaugggcgaggccgccgccaucuucaugaccgcgacgccgcccggguccguggaggccuucccccagagcaacgcccucauccaggacgaggagcgggacaucccggagcgcuccuggaacagcggcuacgaguggaucaccgacuuccccgggaagaccgucugguucgugcccuccaucaagagcggcaacgacaucgccaacugccugcggaagaacggcaagcgcgugauccagcugucccggaagaccuucgacacggaguaccagaagaccaagaacaacgacugggacuacgucgugaccaccgacaucagcgagaugggggcgaacuuccgcgccgaccgggugaucgacccccgccggugccucaagccggucauccugaaggacggccccgagcgcgugauccuggccgggcccaugcccgugacggucgccuccgccgcgcagcggcgcggccggaucgggcgcaaccacaacaaggagggcgaccaguacaucuacaugggccagccgcucaacaacgacgaggaccacgcccacuggaccgaggccaagaugcugcuggacaacaucaacacccccgaggggaucauccccgcccucuucgagcccgagcgcgagaaguccgccgcgaucgacggcgaguaccggcugcgcggggaggcccggaagaccuucguggagcugaugcgccggggcgaccucccggucuggcugagcuacaagguggccuccgagggguuccaguacagcgaccgccgguggugcuucgacggcgagcgcaacaaccaggugcuggaggagaacauggacgucgagaucuggacgaaggagggcgagcggaagaagcuccgcccccgguggcuggacgcccgcaccuacuccgacccccuggcccuccgggaguucaaggaguucgcggccgggcgccggagcguguccggcgaccugauccuggagaucgggaagcucccccagcaccugacccagcgcgcccagaacgcccuggacaaccucgugaugcugcacaacagcgagcagggcggccgggcguaccgccacgccauggaggagcugccggacaccaucgagacgcucaugcugcuggcccucaucgccguccugaccgggggcgugacccuguucuuccucuccgggcggggccuggggaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucggccuccucuucaugauccugacgguggccgcgaacgagauggggcugcucgagaccaccaagaaggaccugggcaucgggcacgucgccgugggcaaccaccaccacgccgccaugcuggacguggaccuccaccccgccuccgcguggacccuguacgccgucgccacgaccaucaucacccccaugaugcgccacaccaucgagaacacgaccgccaacaucagccugaccgccaucgcgaaccaggccgccauccucauggggcuggacaagggcuggccgaucuccaagauggacaucggcgugccccugcucgcccuggggugcuacagccaggugaacccccugacccucacggcggccguccugaugcugguggcccacuacgccaucaucggccccgggcuccaggccaaggcgacccgcgaggcccagaagcggaccgccgccggcaucaugaagaacccgaccguggacgggaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgccgucagcauggccaacaucuuccgggggagcuaccucgcgggcgccggccuggccuucucccugaugaagucccucgggggcgggcgccggggcaccggggcccagggcgagacccugggcgagaaguggaagcgccagcugaaccagcucuccaagagcgaguucaacaccuacaagcgguccgggaucacggagguggaccgcagcgaggcgaaggagggccugaagcgcggggagaccaccaagcacgccgugucccgcggcaccgccaagcugcggugguucgucgagcgcaaccuggugaagccggaggggaaggugaucgaccucggcugcggccgcggcggguggagcuacuacugcgccgggcugaagaaggucacggaggugaagggguacaccaagggcgggcccggccacgaggagcccauccccauggccaccuacggguggaaccuggugaagcuccacuccggcaaggacgucuucuucaucccgcccgagaagugcgacacccugcugugcgacaucggggagagcucccccaaccccacgaucgaggagggccgcacccuccgggugcugaagaugguggagccguggcugcgcgggaaccaguucugcaucaagauccucaaccccuacaugcccagcgucguggagacccuggagcagaugcagcggaagcacggcggcaugcuggugcgcaacccccucucccggaacagcacccacgagauguacugggucuccugcgggaccggcaacaucgugagcgcggugaacaugacgucccgcaugcugcugaaccgcuucaccauggcccaccggaagccgaccuacgagcgcgacgucgaccucggggccggcacccggcacguggccguggagcccgaggucgccaaccuggacaucaucggccagcgcaucgagaacaucaagcacgagcacaagagcacguggcacuacgacgaggacaaccccuacaagaccugggcguaccacggguccuacgaggugaagcccagcggcagcgccuccagcauggugaacggggucgugaagcugcucaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccugucccgcaacaagaagccgcggaucugcacccgcgaggaguucacgcggaaggugcgcagcaacgccgccaucggcgccgucuucguggacgagaaccaguggaacuccgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggcccgcaucaccgacaucauggagcccgagcacgcgcugcucgccaaguccaucuucaagcugaccuaccagaacaaggucgugcgcgugcagcggccggccaagaacgggaccgucauggacgugaucagccgccgggaccagcgcggcuccggccaggugggcacguacggccugaacaccuucaccaacauggaggcccagcucauccggcagauggagagcgaggggaucuucucccccagcgagcuggagacccccaaccuggccgagcgcguccucgacuggcuggagaaguacggcguggagcggcugaagcgcauggcgaucuccggggacgacugcguggucaagcccaucgacgaccgguucgccacggcccucaccgcccugaacgacaugggcaaggugcgcaaggacaucccgcagugggagcccagcaagggguggaacgacuggcagcagguccccuucugcagccaccacuuccaccagcugaucaugaaggacggccgggagaucgucgugcccugccgcaaccaggacgagcucgugggccgggcccgcgucucccagggggcgggcuggagccugcgggagaccgccugccuggggaaguccuacgcccagauguggcagcucauguacuuccaccgccgggaccugcgccuggccgcgaacgccaucugcagcgccgugccgguggacuggauccccaccucccggacgaccuggagcauccacgcccaccaccaguggaugaccaccgaggacaugcucuccgucuggaaccgcguguggaucgaggagaaccccuggauggaggacaagacgcacaucagcuccuggggcgacgugcccuaccuggggaagcgcgaggaccaguggugcggcagccugaucggccucaccgcccgggcgaccugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8848 - RNA, 9879 nt, Artificial Sequence
  derived and/or modified CDS sequence (opt1) from DENV-1__HQ891314__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaccgagaugguccugcucaccaugaaggagaaguccuggcuggugcacaagcagugguuccuggaccucccgcugcccuggaccagcggggccagcacgucccaggagaccuggaaccggcaggaccugcucgugaccuucaagaccgcccacgcgaagaagcaggaggucguggugcugggcagccaggagggcgccaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccacggcccgcggggcccggcgcauggcgauccugggcgacaccgccugggacuucggguccaucggcggcguguucaccagcgucgggaagcucgugcaccagaucuucggcaccgccuacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucacggugguggucggggacguggcgggcauccuggcccaggggaagaagaugauccggccccagcccauggagcacaaguacagcuggaagaacuggggcaaggccaagaucaucggcgccgacgugcagaacuccaccuucaucaucgacgggcccaacaccccggagugcagcgacgaccagcgcgcguggaacaucugggaggucgaggacuacggcuucgggaucuucaccacgaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacgcucugguccaacggcgugcuggagagcgagaugaucauccccaagaucuacgggggccccaucucccagcacaacuaccgcccgggguacuucacccagaccgccggccccuggcaccuggggaagcucgagcuggacuucgaccugugcgagggcaccacgguggucguggacgagcacugcggcaaccgggggcccagccuccgcaccaccaccgugacgggcaagaucauccacgaguggugcugccgguccugcacccugccgccccugcgcuuccgcggggaggacggcugcugguacgggauggagauccgccccgucaaggagaaggaggagaaccucgucaagagcauggugagcgccggcuccggcgagguggacagcuucucccuggggcugcucugcaucagcaucaugaucgaggaggugaugcggucccgcuggagccggaagaugcugaugaccggcacccuggccguguucuuccuccugaucauggggcagcugacguggaacgaccucauccgccugugcaucauggucggcgcgaacgccuccgaccgcauggggaugggcaccaccuaccuggcccucauggccaccuucaagaugcggcccauguucgccgugggccugcuguuccgccggcucacgagccgcgaggugcugcugcucaccaucgggcugucccuggucgcgagcguggagcucccgaacucccuggaggagcugggcgacgggcucgccaugggcaucaugauccugaagcugcucaccgacuuccagagccaccagcugugggccacccugcucuccaugacguucaucaagaccaccuucagccugcacuacgccuggaagaccauggcgaugguccuguccaucgugagccucuucccccugugccuguccacgaccagccagaagaccaccuggcuccccgugcugcugggcucccucgggugcaagccccugacgauguuccugaucgccgagaacaagaucuggggccggaaguccuggccgcucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgcgacgacacccugaccauccuccugaaggccacccugcucgccgugagcggcguguacccccuguccaucccggccacgcuguucgucugguacuucuggcagaagaagaagcagcggagcggggugcucugggacacccccagcccgcccaagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagccguccugggccagcgugaagaaggaccugaucuccuacggcggcggguggcgccuccagggcagcuggaacacgggggaggaggugcaggucaucgccguggagcccggcaagaaccccaagaacgugcagaccgcccccgggaccuucaagaccccggagggcgaggucggcgccaucgcgcuggacuucaagcccgggacguccggcagccccaucgugaaccgggaggggaagaucgugggccuguacggcaacggggucgugaccaccagcggcaccuacguguccgccaucgcccaggccaaggcgagccaggaggggccccucccggagaucgaggacgaggucuuccgcaagcggaaccugacgaucauggaccugcaccccggcuccgggaagacccgccgguaccuccccgccaucgugcgcgaggccaucaagcggaagaugcgcacccugauccuggccccgacccgcguggucgccagcgagauggcggaggcccucaagggcaugcccauccgguaccagacgaccgccgugaaguccgagcacaccggcaaggagaucguggaccugaugugccacgccaccuucacgaugcgccugcucagccccguccgggugcccaacuacaacaugaucaucauggacgaggcccacuucaccgacccguccagcaucgcggcccgcggguacaucuccacccgggugggcaugggggaggccgccgccaucuucaugaccgcgacgccgcccggcagcgucgaggccuucccccaguccaacgccgugauccaggacgaggagcgcgacaucccggagcggagcuggaacuccggguacgaguggaucaccgacuuccccggcaagaccgugugguucguccccagcaucaaggccggcaacgacaucgcgaacugccugcgcaagaacgggaagcgggugauccagcugucccgcaagaccuucgacacggaguaccagaagaccaagaacaacgacugggacuacguggucaccaccgacaucagcgagaugggcgccaacuuccgggccgaccgcgugaucgacccccggcgcugccucaagccggugauccugaaggacgggcccgagcgggucauccuggccggccccaugcccgugacggucgccuccgcggcccagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaaguccgcggccaucgacggggaguaccgccugcggggcgaggcccgcaagaccuucguggagcugaugcggcgcggggaccucccgguguggcuguccuacaaggucgccagcgagggcuuccaguacagcgaccggcgcuggugcuucgacggcgagcggaacaaccaggugcuggaggagaacauggacguggagaucuggacgaaggagggggagcgcaagaagcuccggccccgcuggcuggacgcccggaccuacuccgacccccuggcgcuccgcgaguucaaggaguucgccgccggccggcgcagcgucuccggggaccugauccuggagaucggcaagcucccccagcaccugacccagcgggcccagaacgcgcuggacaaccucgugaugcugcacaacagcgagcagggcgggcgcgccuaccggcacgccauggaggagcugccggacaccaucgagacgcucaugcugcuggcccucaucgccgugcugaccggcggggucacccuguucuuccucuccggcaaggggcugggcaagaccagcaucggccugcucugcgugauggcguccagcgcccugcuguggauggccuccguggagccccacuggaucgccgccagcaucauccucgaguucuuccugaugguccugcucauccccgagcccgaccgccagcggaccccgcaggacaaccagcuggcguacguggugaucgggcuccuguucaugauccugacggucgccgccaacgagaugggccugcucgagaccaccaagaaggaccuggggaucggccacguggccguggagaaccaccaccacgccgcgaugcuggacgucgaccuccaccccgccuccgccuggacccuguacgccguggccacgaccaucaucacccccaugaugcgccacaccaucgagaacacgaccgcgaacaucagccugaccgccaucgccaaccaggccgcgauccucauggggcuggacaagggcuggccgaucuccaagauggacaucggcgugccccugcucgcccuggggugcuacagccaggucaacccccugacccucacggccgccgugcugaugcugguggcccacuacgcgaucaucggccccgggcuccaggccaaggccacccgggaggcccagaagcgcaccgccgcgggcaucaugaagaacccgaccaucgacgggaucgucgccaucgaccuggaccccgugguguacgacgccaaguucgagaagcagcugggccagaucaugcuccugauccugugcacgucccagauccuccugaugcgcaccaccugggcccugugcgagagcaucacccucgccacgggcccccugaccacccugugggaggggucccccggcaaguucuggaacaccacgaucgcggucagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucuccaagagcgaguucaacaccuacaagcgguccgggaucauggagguggaccgcagcgaggccaaggagggccugaagcgcggggagacgaccaagcacgccgugucccgcggcaccgccaagcugcggugguucgucgagcgcaaccucgugaagccggaggggaaggugaucgaccugggcugcggccgcggcggguggagcuacuacugcgcggggcugaagaaggucaccgaggugaagggguacacgaagggcggccccggccacgaggagcccauccccauggccaccuacggguggaaccuggugaagcuccacuccggcaaggacgucuucuucaucccgcccgagaagugcgacacccugcugugcgacaucggggagagcucccccaaccccaccaucgaggagggccgcacgcuccgggugcugaagaugguggagccguggcugcgcgggaaccaguucugcaucaagauccucaaccccuacaugcccagcgucguggagacccuggagcagaugcagcggaagcacggcggcaugcuggugcgcaacccccucucccggaacagcacccacgagauguacugggucuccugcgggaccggcaacaucgugagcgccgugaacaugaccucccgcaugcugcugaaccgguucacgauggcccaccgcaagccgaccuacgagcgcgacgucgaccucggggccggcacccggcacguggcgguggagcccgaggucgccaaccuggacaucaucggccagcgcaucgagaacaucaagcacgagcacaagagcaccuggcacuacgacgaggacaaccccuacaagacgugggccuaccacggguccuacgaggugaagcccagcggcuccgccagcagcauggugaacggggucgugaagcugcucaccaagccgugggacgucauccccauggugacccagaucgccaugaccgacacgacccccuucggccagcagcggguguucaaggagaaggucgacacccgcacccccaaggcgaagcgggggacggcccagaucauggaggugaccgcccgcuggcugugguccuuccugagccggaacaagaagccgcgcaucugcacccgggaggaguucacccgcaaggugcgguccaacgccgcgaucggcgccgucuucguggacgagaaccaguggaacagcgccaaggaggccguggaggacgaccgcuucugggaccucguccaccgggagcgcgagcugcacaagcagggcaagugcgccacgugcguguacaacaugauggggaagcgggagaagaagcugggcgaguucgggaaggcgaagggcucccgcgccaucugguacauguggcucggggcccgguuccuggaguucgaggcccugggcuucaugaacgaggaccacugguucagccgcgagaacucccucagcggcguggagggggagggccugcacaagcugggguacauccuccgggacaucuccaagauccccggcgggaacauguacgccgacgacaccgcgggcugggacacccgcaucaccgaggacgaccugcagaacgaggccaagaucacggacaucauggagcccgagcacgcccugcucgccaagagcaucuucaagcugaccuaccagaacaaggucgugcgggugcagcgcccggccaagaacggcaccgucauggacgugaucucccgccgggaccagcgcgggagcggccagguggggaccuacggccugaacacguucaccaacauggaggcgcagcucauccggcagauggaguccgaggagaucuucagccccaacgagcuggagacccccaaccuggccgagcgcguccucgacuggcuggagaaguacggcguggagcggcugaagcgcauggccaucuccggggacgacugcguggucaagcccaucgacgaccgguucgccaccgcccucacggcgcugaacgacaugggcaaggugcgcaaggacaucccgcagugggagcccagcaagggguggaacgacuggcagcagguccccuucugcucccaccacuuccaccagcugaucaugaaggacggccgggagaucgucgugcccugccgcaaccaggacgagcucguggggcgggcccgcgucagccagggcgccggcuggagccugcgggagaccgccugccuggggaaguccuacgcgcagauguggcagcucauguacuuccaccgccgggaccugcgccuggccgccaacgccaucugcagcgccgugccgguggacuggguccccaccucccggaccacguggagcauccacgcgcaccaccaguggaugaccaccgaggacaugcucuccguguggaaccgcguguggaucgaggagaaccccuggauggaggacaagacccgggucagcuccugggaggacgugcccuaccugggcaagcgcgaggaccaguggugcgggagccugaucggccucacggcccgcgccaccugggccaccaacauccagguggccaucaaccagguccggcgccugaucgggaacgagaacuacuccgacuacaugaccagcaugaagcgguucaagaacgaguccgagccggagggcgcgcugugguga

SEQ ID NO: 8849 - RNA, 9879 nt, Artificial Sequence
  derived and/or modified CDS sequence (opt1) from DENV-1__HQ891315__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaagaacuggggcaaggccaagaucaucggcgccgacgugcagaacuccacguucaucaucgacgggcccaacaccccggagugcagcgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccucugguccaacggcgugcuggagagcgagaugaucauccccaagaucuacgggggccccaucucccagcacaacuaccgcccgggguacuucacgcagaccgccggccccuggcaccuggggaagcucgagcuggacuucgaccugugcgagggcaccaccguggucguggacgagcacugcggcaaccgggggcccagccuccgcacgaccaccgugaccggcaagaucauccacgaguggugcugccgguccugcacgcugccgccccugcgcuuccgcggggaggacggcugcugguacgggauggagauccgccccgucaaggagaaggaggagaaccucgucaagagcaucgugagcgccggcuccggcgagguggacagcuucucccuggggcugcucugcaucagcaucaugaucgaggaggugaugcggucccgcuggagccggaagaugcugaugaccggcacccuggccguguucuuccuccugaucauggggcagcugaccuggaacgaccucauccgccugugcaucauggucggcgcgaacgccuccgaccgcauggggaugggcacgaccuaccuggcccucauggccaccuucaagaugcggcccauguucgccgugggccugcuguuccgccggcucaccagccgcgaggugcugcugcucacgaucgggcugucccuggucgcgagcguggagcucccgaacucccuggaggagcugggcgacgggcucgccaugggcaucaugauccugaagcugcucaccgacuuccagagccaccagcugugggccacccugcucuccaugaccuucaucaagacgaccuucagccugcacuacgccuggaagaccauggcgaugguccuguccaucgugagccucuucccccugugccuguccaccacgagccagaagaccaccuggcuccccgugcugcugggcucccucgggugcaagccccugaccauguuccugaucgccgagaacaagaucuggggccggaaguccuggccgcucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccccuguccaucccggccacccuguucgucugguacuucuggcagaagaagaagcagcggagcggggugcucugggacacgcccagcccgcccaagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagccguccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccccggagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccccucccggagaucgaggacgaggucuuccgcaagcggaaccugaccaucauggaccugcaccccggcuccgggaagacgcgccgguaccuccccgccaucgugcgcgaggccaucaagcggaagaugcgcacccugauccuggccccgacccgcguggucgccagcgagauggcggaggcccucaagggcaugcccauccgguaccagaccacggccgugaaguccgagcacaccggcaaggagaucguggaccugaugugccacgccaccuucaccaugcgccugcucagccccguccgggugcccaacuacaacaugaucaucauggacgaggcccacuucacggacccguccagcaucgcggcccgcggguacaucuccacccgggugggcaugggggaggccgccgccaucuucaugaccgcgacgccgcccggcagcgucgaggccuucccccaguccaacgccgugauccaggacgaggagcgcgacaucccggagcggagcuggaacuccggguacgaguggaucacggacuuccccggcaagaccgugugguucguccccagcaucaaggccggcaacgacaucgcgaacugccugcgcaagaacgggaagcgggugauccagcugucccgcaagaccuucgacaccgaguaccagaagacgaagaacaacgacugggacuacguggucaccaccgacaucagcgagaugggcgccaacuuccgggccgaccgcgugaucgacccccggcgcugccucaagccggugauccugaaggacgggcccgagcgggucauccuggccggccccaugcccgugaccgucgccuccgcggcccagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgcggccaucgacggggaguaccgccugcggggcgaggcccgcaagaccuucguggagcugaugcggcgcggggaccucccgguguggcuguccuacaaggucgccagcgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggacguacuccgacccccuggcgcuccgcgaguucaaggaguucgccgccggccggcgcagcgucuccggggaccugauccuggagaucggcaagcucccccagcaccugacccagcgggcccagaacgcgcuggacaaccucgugaugcugcacaacagcgagcagggcgggcgcgccuaccggcacgccauggaggagcugccggacaccaucgagacccucaugcugcuggcccucaucgccgugcugacgggcggggucacccuguucuuccucuccggcaaggggcugggcaagaccagcaucggccugcucugcgugauggcguccagcgcccugcuguggauggccuccguggagccccacuggaucgccgccagcaucauccucgaguucuuccugaugguccugcucauccccgagcccgaccgccagcggaccccgcaggacaaccagcuggcguacguggugaucgggcuccuguucaugauccugaccgucgccgccaacgagaugggccugcucgagacgaccaagaaggaccuggggaucggccacguggccguggagaaccaccaccacgccgcgaugcuggacgucgaccuccaccccgccuccgccuggacccuguacgccguggccaccacgaucaucacccccaugaugcgccacaccaucgagaacaccacggcgaacaucagccugaccgccaucgccaaccaggccgcgauccucauggggcuggacaagggcuggccgaucuccaagauggacaucggcgugccccugcucgcccuggggugcuacagccaggucaacccccugacccucaccgccgccgugcugaugcugguggcccacuacgcgaucaucggccccgggcuccaggccaaggccacgcgggaggcccagaagcgcaccgccgcgggcaucaugaagaacccgaccaucgacgggaucgucgccaucgaccuggaccccgugguguacgacgccaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgcggucagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgcggggcugaagaaggucaccgaggugaagggguacaccaagggcggccccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgccgugaacaugaccucccgcaugcugcugaaccgguucaccauggcccaccgcaagccgacguacgagcgcgacgucgaccucggggccggcacccggcacguggcgguggagcccgaggucgccaaccuggacaucaucggccagcgcaucgagaacaucaagcacgagcacaagagcaccuggcacuacgacgaggacaaccccuacaagaccugggccuaccacggguccuacgaggugaagcccagcggcuccgccagcagcauggugaacggggucgugaagcugcucacgaagccgugggacgucauccccauggugacccagaucgccaugaccgacaccacgcccuucggccagcagcggguguucaaggagaaggucgacacccgcacccccaaggcgaagcgggggaccgcccagaucauggaggugacggcccgcuggcugugguccuuccugagccggaacaagaagccgcgcaucugcacccgggaggaguucacccgcaaggugcgguccaacgccgcgaucggcgccgucuucguggacgagaaccaguggaacagcgccaaggaggccguggaggacgaccgcuucugggaccucguccaccgggagcgcgagcugcacaagcagggcaagugcgcgaccugcguguacaacaugauggggaagcgggagaagaagcugggcgaguucgggaaggcgaagggcucccgcgccaucugguacauguggcucggggcccgguuccuggaguucgaggcccugggcuucaugaacgaggaccacugguucagccgcgagaacucccucagcggcguggagggggagggccugcacaagcugggguacauccuccgggacaucuccaagauccccggcgggaacauguacgccgacgacacggcgggcugggacacccgcaucaccgaggacgaccugcagaacgaggccaagaucaccgacaucauggagcccgagcacgcccugcucgccaagagcaucuucaagcugacguaccagaacaaggucgugcgggugcagcgcccggccaagaacggcaccgucauggacgugaucucccgccgggaccagcgcgggagcggccagguggggaccuacggccugaacaccuucacgaacauggaggcgcagcucauccggcagauggaguccgaggagaucuucagccccaacgagcuggagacccccaaccuggccgagcgcguccucgacuggcuggagaaguacggcguggagcggcugaagcgcauggccaucuccggggacgacugcguggucaagcccaucgacgaccgguucgccaccgcccucaccgcgcugaacgacaugggcaaggugcgcaaggacaucccgcagugggagcccagcaagggguggaacgacuggcagcagguccccuucugcucccaccacuuccaccagcugaucaugaaggacggccgggagaucgucgugcccugccgcaaccaggacgagcucguggggcgggcccgcgucagccagggcgccggcuggagccugcgggagacggccugccuggggaaguccuacgcgcagauguggcagcucauguacuuccaccgccgggaccugcgccuggccgccaacgccaucugcagcgccgugccgguggacuggguccccaccucccggaccaccuggagcauccacgcgcaccaccaguggaugacgaccgaggacaugcucuccguguggaaccgcguguggaucgaggagaaccccuggauggaggacaagacccgggucagcuccugggaggacgugcccuaccugggcaagcgcgaggaccaguggugcgggagccugaucggccucaccgcccgcgccacgugggccaccaacauccagguggccaucaaccagguccggcgccugaucgggaacgagaacuacuccgacuacaugaccagcaugaagcgguucaagaacgaguccgagccggagggcgcgcugugguga

SEQ ID NO: 8850 - RNA, 9879 nt, Artificial Sequence
  derived and/or modified CDS sequence (opt1) from DENV-1__HQ891316__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaagaacuggggcaaggccaagaucaucggcgccgacgugcagaacuccacguucaucaucgacgggcccaacaccccggagugcagcgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccucugguccaacggcgugcuggagagcgagaugaucauccccaagaucuacgggggccccaucucccagcacaacuaccgcccgggguacuucacgcagaccgccggccccuggcaccuggggaagcucgagcuggacuucgaccugugcgagggcaccaccguggucguggacgagcacugcggcaaccgggggcccagccuccgcacgaccaccgugaccggcaagaucauccacgaguggugcugccgguccugcacgcugccgccccugcgcuuccgcggggaggacggcugcugguacgggauggagauccgccccgucaaggagaaggaggagaaccucgucaagagcauggugagcgccggcuccggcgagguggacagcuucucccuggggcugcucugcaucagcaucaugaucgaggaggugaugcggucccgcuggagccggaagaugcugaugaccggcacccuggccguguucuuccuccugaucauggggcagcugaccuggaacgaccucauccgccugugcaucauggucggcgcgaacgccuccgaccgcauggggaugggcacgaccuaccuggcccucauggccaccuucaagaugcggcccauguucgccgugggccugcuguuccgccggcucaccagccgcgaggugcugcugcucacgaucgggcugucccuggucgcgagcguggagcucccgaacucccuggaggagcugggcgacgggcucgccaugggcaucaugauccugaagcugcucaccgacuuccagagccaccagcugugggccacccugcucuccaugaccuucaucaagacgaccuucagccugcacuacgccuggaagaccauggcgaugguccuguccaucgugagccucuucccccugugccuguccaccacgagccagaagaccaccuggcuccccgugcugcugggcucccucgggugcaagccccugaccauguuccugaucgccgagaacaagaucuggggccggaaguccuggccgcucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggacgaugaagaucaaggacgaggagcgcgacgacacccugaccauccuccugaaggccacccugcucgccgugagcggcguguacccccuguccaucccggccacccuguucgucugguacuucuggcagaagaagaagcagcggagcggggugcucugggacacgcccagcccgcccaagguggagcgcgccguccuggacgacggcaucuaccggaucaugcagcgcggccugcuggggcggagccaggugggcgugggggucuuccaggagaacguguuccacaccauguggcacgugacccgcggcgcgguccucauguaccaggggaagcggcuggagccguccugggccagcgugaagaaggaccugaucuccuacggcggcggguggcgccuccagggcagcuggaacaccggggaggaggugcaggucaucgccguggagcccggcaagaaccccaagaacgugcagacggcccccgggaccuucaagaccccggagggcgaggucggcgccaucgcgcuggacuucaagcccgggaccuccggcagccccaucgugaaccgggaggggaagaucgugggccuguacggcaacggggucgugacgaccagcggcaccuacguguccgccaucgcccaggccaaggcgagccaggaggggccccucccggagaucgaggacgaggucuuccgcaagcggaaccugaccaucauggaccugcaccccggcuccgggaagacgcgccgguaccuccccgccaucgugcgcgaggccaucaagcggaagaugcgcacccugauccuggccccgacccgcguggucgccagcgagauggcggaggcccucaagggcaugcccauccgguaccagaccacggccgugaaguccgagcacaccggcaaggagaucguggaccugaugugccacgccaccuucaccaugcgccugcucagccccguccgggugcccaacuacaacaugaucaucauggacgaggcccacuucacggacccguccagcaucgcggcccgcggguacaucuccacccgggugggcaugggggaggccgccgccaucuucaugaccgcgacgccgcccggcagcgucgaggccuucccccaguccaacgccgugauccaggacgaggagcgcgacaucccggagcggagcuggaacuccggguacgaguggaucacggacuuccccggcaagaccgugugguucguccccagcaucaaggccggcaacgacaucgcgaacugccugcgcaagaacgggaagcgggugauccagcugucccgcaagaccuucgacaccgaguaccagaagacgaagaacaacgacugggacuacguggucaccaccgacaucagcgagaugggcgccaacuuccgggccgaccgcgugaucgacccccggcgcugccucaagccggugauccugaaggacgggcccgagcgggucauccuggccggccccaugcccgugaccgucgccuccgcggcccagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgcggccaucgacggggaguaccgccugcggggcgaggcccgcaagaccuucguggagcugaugcggcgcggggaccucccgguguggcuguccuacaaggucgccagcgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggacguacuccgacccccuggcgcuccgcgaguucaaggaguucgccgccggccggcgcagcgucuccggggaccugauccuggagaucggcaagcucccccagcaccugacccagcgggcccagaacgcgcuggacaaccucgugaugcugcacaacagcgagcagggcgggcgcgccuaccggcacgccauggaggagcugccggacaccaucgagacccucaugcugcuggcccucaucgccgugcugacgggcggggucacccuguucuuccucuccggcaaggggcugggcaagaccagcaucggccugcucugcgugauggcguccagcgcccugcuguggauggccuccguggagccccacuggaucgccgccagcaucauccucgaguucuuccugaugguccugcucauccccgagcccgaccgccagcggaccccgcaggacaaccagcuggcguacguggugaucgggcuccuguucaugauccugaccgucgccgccaacgagaugggccugcucgagacgaccaagaaggaccuggggaucggccacguggccguggagaaccaccaccacgccgcgaugcuggacgucgaccuccaccccgccuccgccuggacccuguacgccguggccaccacgaucaucacccccaugaugcgccacaccaucgagaacaccacggcgaacaucagccugaccgccaucgccaaccaggccgcgauccucauggggcuggacaagggcuggccgaucuccaagauggacaucggcgugccccugcucgcccuggggugcuacagccaggucaacccccugacccucaccgccgccgugcugaugcugguggcccacuacgcgaucaucggccccgggcuccaggccaaggccacgcgggaggcccagaagcgcaccgccgcgggcaucaugaagaacccgaccaucgacgggaucgucgccaucgaccuggaccccgugguguacgacgccaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgcggucagcauggccaacaucuuccggggguccuaccucgccggcgccggccuggcguucagccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggccaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgcggggcugaagaaggucaccgaggugaagggguacaccaagggcggccccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgccgugaacaugaccucccgcaugcugcugaaccgguucaccauggcccaccgcaagccgacguacgagcgcgacgucgaccucggggccggcacccggcacguggcgguggagcccgaggucgccaaccuggacaucaucggccagcgcaucgagaacaucaagcacgagcacaagagcaccuggcacuacgacgaggacaaccccuacaagaccugggccuaccacggguccuacgaggugaagcccagcggcuccgccagcagcauggugaacggggucgugaagcugcucacgaagccgugggacgucauccccauggugacccagaucgccaugaccgacaccacgcccuucggccagcagcggguguucaaggagaaggucgacacccgcacccccaaggcgaagcgggggaccgcccagaucauggaggugacggcccgcuggcugugguccuuccugagccggaacaagaagccgcgcaucugcacccgggaggaguucacccgcaaggugcgguccaacgccgcgaucggcgccgucuucguggacgagaaccaguggaacagcgccaaggaggccguggaggacgaccgcuucugggaccucguccaccgggagcgcgagcugcacaagcagggcaagugcgcgaccugcguguacaacaugauggggaagcgggagaagaagcugggcgaguucgggaaggcgaagggcucccgcgccaucugguacauguggcucggggcccgguuccuggaguucgaggcccugggcuucaugaacgaggaccacugguucagccgcgagaacucccucagcggcguggagggggagggccugcacaagcugggguacauccuccgggacaucuccaagauccccggcgggaacauguacgccgacgacacggcgggcugggacacccgcaucaccgaggacgaccugcagaacgaggccaagaucaccgacaucauggagcccgagcacgcccugcucgccaagagcaucuucaagcugacguaccagaacaaggucgugcgggugcagcgcccggccaagaacggcaccgucauggacgugaucucccgccgggaccagcgcgggagcggccagguggggaccuacggccugaacaccuucacgaacauggaggcgcagcucauccggcagauggaguccgaggagaucuucagccccaacgagcuggagacccccaaccuggccgagcgcguccucgacuggcuggagaaguacggcguggagcggcugaagcgcauggccaucuccggggacgacugcguggucaagcccaucgacgaccgguucgccaccgcccucaccgcgcugaacgacaugggcaaggugcgcaaggacaucccgcagugggagcccagcaagggguggaacgacuggcagcagguccccuucugcucccaccacuuccaccagcugaucaugaaggacggccgggagaucgucgugcccugccgcaaccaggacgagcucguggggcgggcccgcgucagccagggcgccggcuggagccugcgggagacggccugccuggggaaguccuacgcgcagauguggcagcucauguacuuccaccgccgggaccugcgccuggccgccaacgccaucugcagcgccgugccgguggacuggguccccaccucccggaccaccuggagcauccacgcgcaccaccaguggaugacgaccgaggacaugcucuccguguggaaccgcguguggaucgaggagaaccccuggauggaggacaagacccgggucagcuccugggaggacgugcccuaccugggcaagcgcgaggaccaguggugcgggagccugaucggccucaccgcccgcgccacgugggccaccaacauccagguggccaucaaccagguccggcgccugaucgggaacgagaacuacuccgacuacaugaccagcaugaagcgguucaagaacgaguccgagccggagggcgcgcugugguga

SEQ ID NO: 8851 - RNA, 9879 nt, Artificial Sequence
  derived and/or modified CDS sequence (opt1) from DENV-1__JN054256__SS-prME
agcgugaccaugcugcucaugcugaugcccaccgcccuggccuuccaccucacgacccgggagggcgagccccacaugaucgugagcaagcaggagcggggcaagagccugcuguucaagaccagcgccggcgugaacaugugcacccucaucgccauggaccugggggagcugugcgaggacaccaugaccuacaagugcccccggaucaccgaggccgagcccgacgacguggacugcuggugcaacgccaccgacacgugggucaccuacgggaccugcagccagaccggggagcaccggcgcgacaagcgguccguggcccucgcgccccacgugggccugggccuggagacgcgcaccgagaccuggaugagcuccgagggggccuggaagcagauccagcgggucgagaccugggcccuccgccaccccggcuucacggugaucgcccuguuccuggcgcacgccaucgggaccagcaucacccagaagggcaucaucuucauccuccugaugcuggugacccccuccauggccaugcggugcgucgggaucggcagccgcgacuucguggagggccucuccggggccacguggguggacgucgugcuggagcacggcagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggggaggccacccugguggaggagcaggacgccaacuucgucugccggcgcaccuucguggaccggggcuggggcaacgggugcggccuguucgggaagggcucccuccugacgugcgccaaguucaagugcgugaccaagcuggaggggaagaucguccaguacgagaaccucaaguacagcgugaucgugaccguccacaccggcgaccagcaccaggugggcaacgaguccacggagcacgggaccaccgcgaccaucacgccccaggcccccacgaccgagauccagcugaccgacuacggcgcccugacccucgacugcagcccccgcacggggcuggacuucaccgagaugguccugcucaccaugaaggagaaguccuggcuggugcacaagcagugguuccuggaccucccgcugcccuggaccagcggcgccagcacgucccaggagaccuggaaccggcaggaccugcucgugaccuucaagaccgcccacgcgaagaagcaggaggucguggugcuggggagccaggagggcgccaugcacacggcccugaccggcgccaccgagauccagaccuccgggacgaccaccaucuucgccggccaccucaagugccgccugaagauggacaagcugacccucaaggggaugagcuacgucaugugcacgggcuccuucaagcuggagaaggagguggcggagacccagcacgggaccgugcugguccagaucaaguacgagggcaccgacgcccccugcaagauccccuucagcacgcaggacgagaagggcgugacccagaacgggcggcugaucaccgccaacccgaucgugaccgacaaggagaagcccgucaacaucgaggccgagccgcccuucggcgaguccuacaucgugaucggggcgggcgagaaggcccucaagcugagcugguucaagaagggcuccagcaucgggaagauguucgaggccacggcccgcggcgcccggcgcauggcgauccugggggacaccgccugggacuucggcuccaucgggggcguguucaccagcgucggcaagcucgugcaccagaucuucgggaccgccuacggcgugcuguucuccggggucagcuggacgaugaagaucggcaucggggugcugcucaccuggcugggccugaacucccgcagcaccucccucagcaugaccugcaucgccgugggccuggucacgcuguaccucggggugauggugcaggccgacuccggcugcgucaucaacuggaaggggcgggagcugaagugcggcagcgggaucuucgugaccaacgaggugcacaccuggaccgagcaguacaaguuccaggcggacagcccgaagcgccuguccgccgccaucggcaaggccugggaggagggcgucugcgggauccggagcgccacccgccucgagaacaucauguggaagcagaucuccaacgagcugaaccacauccugcucgagaacgacaugaagcugacggugguggucggcgacguggcggggauccuggcccagggcaagaagaugauccggccccagcccauggagcacaaguacagcuggaagaacugggggaaggccaagaucaucggcgccgacgugcagaacuccaccuucaucaucgacggccccaacaccccggagugcagcgacgaccagcgcgcguggaacaucugggaggucgaggacuacggguucggcaucuucaccacgaacaucuggcucaagcugcgggacuccuacacccaggugugcgaccaccgccugaugagcgccgccaucaaggacuccaaggccgugcacgccgacaugggguacuggaucgagagcgagaagaacgagaccuggaagcucgcgcgggccuccuucaucgaggucaagaccugcaucuggcccaagagccacacgcugugguccaacggcgugcuggagagcgagaugaucauccccaagaucuacggcgggcccaucucccagcacaacuaccgcccgggcuacuucacccagaccgccgggcccuggcaccucggcaagcuggagcuggacuucgaccucugcgaggggaccacgguggucguggacgagcacugcggcaaccggggccccagccugcgcaccaccaccgugacggggaagaucauccacgaguggugcugccgguccugcacccugccgccccuccgcuuccggggcgaggacgggugcugguacggcauggagauccgccccgucaaggagaaggaggagaaccuggugaaguccauggugagcgccggguccggcgaggucgacagcuucucccugggccuccugugcaucagcaucaugaucgaggaggugaugcggucccgcuggagccggaagaugcugaugaccgggacccucgccguguucuuccugcugaucaugggccagcucacguggaacgaccugauccgccugugcaucauggucggggcgaacgccuccgaccgcaugggcauggggaccaccuaccucgcccugauggccaccuucaagaugcggcccauguucgccgugggccuccuguuccgccggcugacgagccgcgaggugcugcuccugaccaucggccugucccucgucgcgagcguggagcugccgaacucccuggaggagcucggggacggccuggccauggggaucaugauccugaagcuccugaucgacuuccagagccaccagcugugggccacccuccuguccaugaccuucaucaagacgaccuucagccugcacuacgccuggaagaccauggcgaugguccucuccaucgugagccuguucccccugugccucuccaccacgagccagaagaccaccuggcugcccgugcugcucggcucccugggcugcaagccccugaccauguuccucaucgccgagaacaagaucugggggcgcaagagcuggccgcugaacgagggcaucauggccgucgggaucgugagcauccugcucuccagccugcugaagaacgacgugccccucgccggcccccugaucgccgggggcaugcugaucgcgugcuacgucaucuccggcagcuccgccgaccucagccuggagaaggccgccgagguguccugggaggaggaggccgagcacagcggggcgucccacaacauccugguggagguccaggacgacggcacgaugaagaucaaggacgaggagcgcgacgacacccucaccauccugcugaaggccacccuccuggccgugagcgggguguacccccuguccaucccggccacccucuucgucugguacuucuggcagaagaagaagcagcggagcggcgugcugugggacacgcccagcccgcccaagguggagcgcgccguccuggacgacgggaucuaccggaucaugcagcgcggccugcucggccggagccaggugggggugggcgucuuccaggagaacguguuccacaccauguggcacgugacccgcggggcgguccugauguaccagggcaagcggcuggagccguccugggccagcgugaagaaggaccucaucuccuacgggggcggcuggcgccugcaggggagcuggaacaccggcgaggaggugcaggucaucgccguggagcccgggaagaaccccaagaacgugcagacggcccccggcaccuucaagaccccggagggggaggucggcgccaucgcgcuggacuucaagcccggcaccuccgggagccccaucgugaaccgggagggcaagaucguggggcucuacggcaacggcgucgugacgaccagcgggaccuacguguccgccaucgcccaggccaaggcgagccaggagggcccccugccggagaucgaggacgaggucuuccgcaagcggaaccugaccaucauggaccuccaccccggguccggcaagacgcgccgguaccugcccgccaucgugcgcgaggccaucaagcggaagaugcgcacccugauccucgccccgacccgcguggucgccagcgagauggcggaggcccugaaggggaugcccauccgguaccagaccacggccgugaaguccgagcacaccggcaaggagaucguggaccugaugugccacgccaccuucaccaugcgccuccugagccccguccgggugcccaacuacaacaugaucaucauggacgaggcccacuucacggacccguccagcaucgcggcccgcggcuacaucuccacccggguggggaugggcgaggccgccgccaucuucaugaccgcgacgccgcccgggagcgucgaggccuucccccaguccaacgccgugauccaggacgaggagcgcgacaucccggagcggagcuggaacuccggcuacgaguggaucacggacuuccccgggaagaccgugugguucguccccagcaucaaggccggcaacgacaucgcgaacugccugcgcaagaacggcaagcgggugauccagcucucccgcaagaccuucgacaccgaguaccagaagacgaagaacaacgacugggacuacguggucaccaccgacaucagcgagaugggggccaacuuccgggccgaccgcgugaucgacccccggcgcugccugaagccggugauccugaaggacggccccgagcgggucauccucgccgggcccaugcccgugaccgucgccuccgcggcccagcgccggggccgcaucgggcggaaccacaacaaggagggcgaccaguacaucuacaugggccagccgcugaacaacgacgaggaccacgcccacuggacggaggccaagaugcugcucgacaacaucaacacccccgaggggaucauccccgcccuguucgagcccgagcgcgagaaguccgcggccaucgacggcgaguaccgccugcgcggggaggcccgcaagaccuucguggagcucaugcggcgcggcgaccugccgguguggcuguccuacaaggucgccagcgagggguuccaguacagcgaccggcgcuggugcuucgacggcgagcggaacaaccaggugcucgaggagaacauggacguggagaucuggaccaaggagggcgagcgcaagaagcugcggccccgcuggcuggacgcccggacguacuccgacccccucgcgcugcgcgaguucaaggaguucgccgccgggcggcgcagcgucuccggcgaccugauccucgagaucgggaagcugccccagcaccugacccagcgggcccagaacgcgcucgacaaccuggugaugcugcacaacagcgagcagggcggccgcgccuaccggcacgccauggaggagcucccggacaccaucgagacccugaugcugcucgcccugaucgccgugcugaccggcggggucacccucuucuuccuguccgggaaggggcuggggaagaccagcaucggccuccugugcgugauggcguccagcgcccugcucuggauggccuccguggagccccacuggaucgccgccagcaucauccuggaguucuuccugaugguccuccugauccccgagcccgaccgccagcggaccccgcaggacaaccagcuggcguacguggugaucggccuccuguucaugauccugaccgucgccgccaacgagauggggcuccuggagacgaccaagaaggaccugggcaucgggcacguggccguggagaaccaccaccacgccgcgaugcucgacgucgaccugcaccccgccuccgccuggacccuguacgccguggccaccacgaucaucacccccaugaugcgccacaccaucgagaacaccacggcgaacaucagccucaccgccaucgccaaccaggccgcgauccugaugggccuggacaagggguggccgaucuccaagauggacaucggcgugccccuccuggcccugggcugcuacagccaggucaacccccucacccugaccgccgccgugcugaugcucguggcccacuacgcgaucaucgggcccggccugcaggccaaggccacgcgggaggcccagaagcgcaccgccgcggggaucaugaagaacccgaccaucgacggcaucgucgccaucgaccuggaccccgugguguacgacgccaaguucgagaagcagcucgggcagaucaugcugcugauccucugcaccucccagauccugcugaugcgcacgaccugggcccucugcgagagcaucacccuggccaccggcccccugacgacccucugggagggcucccccgggaaguucuggaacaccaccaucgcggucagcauggccaacaucuuccggggcuccuaccuggccggggccggccuggcguucagccucaugaagucccugggcgggggccgccgggggacgggcgcccagggggagacccugggcgagaaguggaagcgccagcucaaccagcuguccaagagcgaguucaacaccuacaagcgguccggcaucauggagguggaccgcagcgaggccaaggaggggcugaagcggggcgagaccacgaagcacgccgugucccgcgggaccgccaagcuccggugguucgucgagcgcaaccuggugaagccggagggcaaggugaucgaccuggggugcggccggggcggguggagcuacuacugcgcgggccugaagaaggucaccgaggugaagggguacaccaagggcgggcccggccacgaggagcccauccccauggccacguacggcuggaaccucgugaagcugcacuccgggaaggacgucuucuucaucccgcccgagaagugcgacacccugcucugcgacaucggcgagagcucccccaaccccaccaucgaggaggggcgcacccugcgggugcugaagaugguggagccguggcuccgcggcaaccaguucugcaucaagauccugaaccccuacaugcccagcgucguggagacgcuggagcagaugcagcggaagcacgggggcaugcucgugcgcaacccccugucccggaacagcacccacgagauguacugggucuccugcggcaccgggaacaucgugagcgccgugaacaugaccucccgcaugcugcucaaccgguucaccauggcccaccgcaagccgacguacgagcgcgacgucgaccugggcgccgggacccggcacguggcgguggagcccgaggucgccaaccuggacaucaucggccagcgcaucgagaacaucaagcacgagcacaagagcaccuggcacuacgacgaggacaaccccuacaagaccugggccuaccacggcuccuacgaggugaagcccagcggguccgccagcagcauggugaacggcgucgugaagcuccugacgaagccgugggacgucauccccauggugacccagaucgccaugaccgacaccacgcccuucgggcagcagcggguguucaaggagaaggucgacacccgcacccccaaggcgaagcggggcaccgcccagaucauggaggugacggcccgcuggcugugguccuuccucagccggaacaagaagccgcgcaucugcacccgggaggaguucacccgcaaggugcgguccaacgccgcgaucggggccgucuucguggacgagaaccaguggaacagcgccaaggaggccguggaggacgaccgcuucugggaccugguccaccgggagcgcgagcugcacaagcagggcaagugcgcgaccugcguguacaacaugaugggcaagcgggagaagaagcucggggaguucggcaaggcgaaggggucccgcgccaucugguacauguggcugggcgcccgguuccuggaguucgaggcccucggguucaugaacgaggaccacugguucagccgcgagaacucccugagcggcguggagggcgaggggcugcacaagcucggcuacauccugcgggacaucuccaagauccccgggggcaacauguacgccgacgacacggcggggugggacacccgcaucaccgaggacgaccugcagaacgaggccaagaucaccgacaucauggagcccgagcacgcccuccuggccaagagcaucuucaagcugacguaccagaacaaggucgugcgggugcagcgcccggccaagaacggcaccgucauggacgugaucucccgccgggaccagcgcggcagcggccaggugggcaccuacgggcucaacaccuucacgaacauggaggcgcagcugauccggcagauggaguccgaggagaucuucagccccaacgagcuggagacccccaaccucgccgagcgcguccuggacuggcuggagaaguacggcguggagcggcucaagcgcauggccaucuccggcgacgacugcguggucaagcccaucgacgaccgguucgccaccgcccugaccgcgcugaacgacauggggaaggugcgcaaggacaucccgcagugggagcccagcaagggcuggaacgacuggcagcagguccccuucugcucccaccacuuccaccagcucaucaugaaggacgggcgggagaucgucgugcccugccgcaaccaggacgagcuggugggccgggcccgcgucagccagggggccggcuggagccugcgggagacggccugccucggcaaguccuacgcgcagauguggcagcugauguacuuccaccgccgggaccugcgccucgccgccaacgccaucugcagcgccgugccgguggacuggguccccaccucccggaccaccuggagcauccacgcgcaccaccaguggaugacgaccgaggacaugcuguccguguggaaccgcguguggaucgaggagaaccccuggauggaggacaagacccgggucagcuccugggaggacgugcccuaccuggggaagcgcgaggaccaguggugcggcagccucaucgggcugaccgcccgcgccacgugggccaccaacauccagguggccaucaaccagguccggcgccugaucggcaacgagaacuacuccgacuacaugaccagcaugaagcgguucaagaacgaguccgagccggagggggcgcucugguga

SEQ ID NO: 8852 - RNA, 9879 nt, Artificial Sequence
  derived and/or modified CDS sequence (opt1) from DENV-1__JN054255__SS-prME
agcgugaccaugcugcucaugcugaugcccaccgcccuggccuuccaccucaccacccggggcggggagccccacaugaucgucagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagauguccggcaccaccacgaucuucgccgggcaccucaagugccgccugaagauggacaagcugacccucaagggcaugagcuacgucaugugcaccggguccuucaagcuggagaaggagguggcggagacccagcacggcacggugcugguccagaucaaguacgagggcaccgacgcccccugcaagauccccuucagcacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacaccgccugggacuucggguccaucggcggcguguucacgagcgucgggaagcucgugcaccagaucuucggcaccgccuacggggugcuguucuccggcgucagcuggaccaugaagaucgggaucggcgugcugcucaccuggcugggccugaacucccgcagcacgucccucagcaugaccugcaucgccguggggcuggucacccuguaccucggcgugauggugcaggccgacuccgggugcgucaucaacuggaagggccgggagcugaagugcgggagcggcaucuucgugaccaacgaggugcacacguggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaagaacuggggcaaggccaagaucaucggcgccgacgugcagaacuccaccuucaucaucgacgggcccaacacgccggagugcagcgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagacguggaagcuggcgcgggccuccuucaucgaggucaagaccugcaucuggcccaagagccacacccucugguccaacggcgugcuggagagcgagaugaucauccccaagaucuacgggggccccaucucccagcacaacuaccgcccgggguacuucacccagacggccggccccuggcaccuggggaagcucgagcuggacuucgaccugugcgagggcaccaccguggucguggacgagcacugcggcaaccgggggcccagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgucaagagcauggugagcgccggcuccggcgagguggacagcuucucccuggggcugcucugcaucagcaucaugaucgaggaggugaugcggucccgcuggagccggaagaugcugaugacgggcacccuggccguguucuuccuccugaucauggggcagcugaccuggaacgaccucauccgccugugcaucauggucggcgcgaacgccuccgaccgcauggggaugggcaccacguaccuggcccucauggccaccuucaagaugcggcccauguucgccgugggccugcuguuccgccggcucaccagccgcgaggugcugcugcucaccaucgggcugucccuggucgcgagcguggagcucccgaacucccuggaggagcugggcgacgggcucgccaugggcaucaugauccugaagcugcucacggacuuccagagccaccagcugugggccacccugcucuccaugaccuucaucaagaccacguucagccugcacuacgccuggaagaccauggcgaugguccuguccaucgugagccucuucccccugugccuguccaccaccagccagaagacgaccuggcuccccgugcugcugggcucccucgggugcaagccccugaccauguuccugaucgccgagaacaagaucuggggccggaaguccuggccgcucaacgaggggaucauggccgucggcaucgugagcauccugcuguccagccuccugaagaacgacgugccccuggccgggccccucaucgccggcggcaugcugaucgcgugcuacgucaucuccgggagcuccgccgaccugagccucgagaaggccgccgagguguccugggaggaggaggccgagcacagcggcgcgucccacaacauccugguggagguccaggacgacgggaccaugaagaucaaggacgaggagcgcgacgacacgcugaccauccuccugaaggccacccugcucgccgugagcggcguguacccccuguccaucccggccacccuguucgucugguacuucuggcagaagaagaagcagcggagcggggugcucugggacacccccagcccgcccaagguggagaaggccguccuggacgacggcaucuaccgcaucaugcagcggggccugcuggggcgcagccaggugggcgugggggucuuccaggagaacguguuccacacgauguggcacgugacccggggcgcgguccucauguaccaggggaagcgccuggagccguccugggccagcgugaagaaggaccugaucuccuacggcggcggguggcggcuccagggcagcuggaacaccggggaggaggugcaggucaucgccguggagcccggcaagaaccccaagaacgugcagaccgcccccgggacguucaagaccccggagggcgaggucggcgccaucgcgcuggacuucaagcccgggaccuccggcagccccaucgugaaccgcgaggggaagaucgugggccuguacggcaacggggucgugaccacgagcggcaccuacguguccgggaucgcccaggccaaggccagccaggagggcccccucccggagaucgaggacgaggucuuccggaagcgcaaccugaccaucauggaccugcaccccggguccggcaagacccggcgcuaccuccccgcgaucgugcgggaggccaucaagcgcaagaugcggacgcugauccuggccccgacccgcguggucgccagcgagauggccgaggcgcucaagggcaugcccauccgcuaccagaccaccgccgugaaguccgagcacacggggaaggagaucguggaccugaugugccacgccaccuucaccaugcggcugcucagccccguccgcgugcccaacuacaacaugaucaucauggacgaggcccacuucaccgacccguccagcaucgccgcgcggggcuacaucuccacgcgcguggggaugggcgaggccgccgccaucuucaugaccgccacgccgcccgggagcgucgaggcguucccccaguccaacgccgugauccaggacgaggagcgggacaucccggagcgcagcuggaacuccggcuacgaguggaucaccgacuuccccggcaagacggugugguucguccccagcaucaaggccgggaacgacaucgccaacugccugcggaagaacggcaagcgcgugauccagcugucccggaagaccuucgacaccgaguaccagaagaccaagaacaacgacugggacuacguggucacgaccgacaucagcgagaugggggcgaacuuccgcgccgaccgggugaucgacccccgccggugccucaagccggugauccugaaggacggccccgagcgcgucauccuggccgggcccaugcccgugaccgucgccuccgccgcgcagcggcgcggccggaucggccgcaaccacaacaaggagggggaccaguacaucuacaugggccagccgcucaacaacgacgagaaccacgcccacuggaccgaggccaagaugcugcuggacaacaucaacacgcccgaggggaucauccccgcccucuucgagcccgagcgggagaaguccgccgcgaucgacggcgaguaccgccugcgcggggaggcccggaagaccuucguggagcugaugcgccggggcgaccucccgguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgcggccgggcgccggagcgucuccggcgaccugauccuggagaucggcaagcucccccagcaccugacgcagcgcgcccagaacgcccuggacaaccucgugaugcugcacaacagcgagcagggcgggcgggcguaccgccacgccauggaggagcugccggacaccaucgagacccucaugcugcuggcccucaucgccgugcugaccgggggcgucacgcuguucuuccucuccgggaagggccugggcaagaccagcaucgggcugcucugcgugauggccuccagcgcgcugcuguggauggccuccguggagccccacuggaucgccgccagcaucauccucgaguucuuccugaugguccugcucauccccgagcccgaccggcagcgcaccccgcaggacaaccagcuggccuacguggugaucggccuccuguucaugauccugaccgucgcggccaacgagauggggcugcucgagaccacgaagaaggaccugggcaucgggcacguggccguggagaaccaccaccacgccgccaugcuggacaucgaccuccaccccgcguccgccuggacccuguacgccgucgccaccaccaucaucacgcccaugaugcggcacaccaucgagaacaccaccgccaacaucagccugacggcgaucgccaaccaggccgccauccucaugggccuggacaagggcuggccgaucuccaagauggacaucggggugccccugcucgcgcugggcugcuacagccaggugaacccccugacccucaccgccgccguccugaugcugguggcccacuacgccaucaucgggcccggccuccaggcgaaggccacccgcgaggcccagaagcggacggccgccgggaucaugaagaacccgaccaucgacggcaucguggcgaucgaccuggaccccgucguguacgacgccaaguucgagaagcagcugggccagaucaugcuccugauccugugcaccucccagauccuccugaugcgcaccacgugggcccugugcgagagcaucacccucgccaccgggccccugaccacgcugugggagggcucccccgggaaguucuggaacaccaccaucgccgugagcauggcgaacaucuuccgcggcuccuaccucgccggcgccgggcuggccuucagccugaugaagucccucggcgggggccggcgcgggaccggcgcgcagggcgagacgcugggggagaaguggaagcggcagcugaaccagcucuccaagagcgaguucaacaccuacaagcgcuccggcaucauggaggucgaccggagcgaggccaaggaggggcugaagcgcggcgagaccaccaagcacgccgugucccgggggacggccaagcugcgcugguucguggagcggaaccucgucaagccggagggcaaggugaucgaccugggcugcgggcgcggcggguggagcuacuacugcgccggccugaagaaggugaccgaggucaagggguacaccaagggcggccccgggcacgaggagcccauccccauggcgaccuacggcuggaaccuggugaagcuccacuccgggaaggacguguucuucaucccgcccgagaagugcgacacgcugcugugcgacaucggcgagagcucccccaaccccaccaucgaggaggggcggacccuccgcguccugaagaugguggagccguggcugcggggcaaccaguucugcaucaagauccucaaccccuacaugcccagcguggucgagacccuggagcagaugcagcgcaagcacggcgggaugcuggugcggaacccccucucccgcaacagcacgcacgagauguacuggguguccugcggcaccgggaacaucgucagcgccgugaacaugaccucccggaugcugcugaaccgcuucaccauggcccaccggaagccgaccuacgagcgcgacguggaccucggcgccggcacgcgccacgucgccguggagcccgagguggcgaaccuggacaucaucgggcagcggaucgagaacaucaagcacgagcacaagagcaccuggcacuacgacgaggacaaccccuacaagaccugggccuaccacggcuccuacgaggucaagcccagcggguccgccagcagcauggugaacggcauggugaagcugcucaccaagccgugggacgucauccccauggugacgcagaucgccaugaccgacaccacccccuucgggcagcagcgcgucuucaaggagaagguggacacgcggacccccaaggccaagcgcggcaccgcgcagaucauggaggugaccgcccgguggcugugguccuuccugagccgcaacaagaagccgcggaucugcacgcgcgaggaguucacccggaagguccgcuccaacgccgccaucggcgcgguguucguggacgagaaccaguggaacagcgccaaggaggccgucgaggacgaccgguucugggaccucgugcaccgcgagcgggagcugcacaagcaggggaagugcgcgaccugcguguacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcggggucgagggcgaggggcugcacaagcugggcuacauccuccgcgacaucuccaagauccccgggggcaacauguacgccgacgacaccgccggcugggacacgcggaucaccgaggacgaccugcagaacgaggcgaagaucaccgacaucauggagcccgagcacgcccugcucgccaagagcaucuucaagcugaccuaccagaacaagguggugcgcguccagcggccguccaagaacgggacggugauggacgugaucagccgccgcgaccagcggggcuccgggcaggucggcaccuacggccugaacaccuucaccaacauggaggcccagcucauccgccagauggagagcgaggagaucuucucccccaacgagcuggagacgcccaaccuggccaagcgggugcucgacuggcuggagaaguacgggguggagcgccugaagcggauggcgaucagcggcgacgacugcgucgugaagcccaucgacgaccgcuucgccaccgcccucaccgcccugaacgacauggggaaggugcggaaggacaucccgcagugggagcccuccaagggcuggaacgacuggcagcagguccccuucugcagccaccacuuccaccagcugaucaugaaggacgggcgcgagaucguggugcccugccggaaccaggacgagcucgucggccgcgcccgggugagccagggcgcgggguggucccugcgcgagaccgccugccugggcaagagcuacgcccagauguggcagcucauguacuuccaccggcgcgaccugcggcuggccgcgaacgccaucugcuccgccgugccggucgacugggugcccacgagccgcaccaccugguccauccacgcccaccaccaguggaugaccacggaggacaugcucagcguguggaaccgggucuggaucgaggagaaccccuggauggaggacaagacccgcguguccagcugggaggacgugcccuaccuggggaagcgggaggaccaguggugcggcucccugaucgggcucaccgcccgcgcgaccugggccacgaacauccaggucgccaucaaccaggugcgccggcugaucggcaacgagaacuacagcgacuacaugaccuccaugaagcgcuucaagaacgagagcgagccggagggcgcccugugguga

SEQ ID NO: 8853 - RNA, 9879 nt, Artificial Sequence
  derived and/or modified CDS sequence (opt1) from DENV-1__KP406801__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacaccaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacgccaacuucgucugccggcgcacguucguggaccggggcugggggaacggcugcggccucuucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgccaagaagcaggaggucguggugcugggcucccaggagggcgcgaugcacaccgcccucgccggggccacggagauccagaugagcggcaccaccaccaucuucgccgggcaccugaagugccgccugaagauggacaagcucacgcugaagggcgucuccuacgugaugugcaccgggagcuucaagcuggagaaggagguggcggagacccagcacggcaccguccugguccaggugaaguacgagggcacggacgcccccugcaagauccccuucuccauccaggacgagaagggggucacccagaacggccggcucaucaccgccaacccgaucgccaccgacaaggagaagcccgugaacaucgagacggagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgggagcugaagugcggguccggcaucuucgugaccaacgagguccacaccuggacggagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccguggucgugggggacgcgaacggcauccugacccaggggaagaagaugauccggccccagcccauggagcacaaguacuccuggaaguccuggggcaaggccaagaucaucggcgccgacacccagaacacgaccuucaucaucgacgggcccgacaccccggagugccccgacgaccagcgcgccuggaacaucugggagguggaggacuacggcuucgggaucuucaccacgaacaucuggcugaagcuccgggacuccuacacccagaugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggccccgcagccacacgcucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcaccacggucgugguggacgagcacugcggcaaccgcgggccgagccuccggaccaccaccgucacgggcaagaucauccacgaguggugcugccgcuccugcacccugccgccccugcgguucaagggggaggacggcugcugguacgggauggagauccgccccgugaaggagaaggaggagaaccucgugcggagcauggucuccgccggcagcggcgagguggacagcuucucccuggggcugcucugcgugagcaucaugaucgaggaggucaugcgcucccgguggagccgcaagaugcugaugaccggcacccuggccguguucuuccuccugaucauggggcagcugacguggaacgaccucauccgccugugcaucauggugggcgccaacgucuccgaccggauggggaugggcaccaccuaccuggcgcucauggccaccuucaagaugcgcccgauguucgccguggggcugcuguuccggcgccucacgagccgggaggugcugcugcucaccaucgggcugucccuggucgccagcguggagcuccccaacucccuggaggagcugggcgacgggcucgccaugggcaucaugaugcugaagcugcucaccgacuuccagagccaccagcuguggaccacgcugcucucccugaccuucaucaagaccacccugagccucgacuacgcguggaagacgaucgccaugguccuguccaucgugagccuguucccccucugccuguccaccaccagccagaagaccacguggcugcccgugcuccugggcuccuucgggugcaagccgcugaccauguuccucaucaccgagaacaagaucuggggccgccggagcuggccccugaacgaggggaucauggccgucggcaucguguccauccugcucagcagccugcugaagaacgacgugccccucgccgggccccugaucgcgggcggcaugcugaucgccugcuacgucaucuccgggagcuccgccgaccucagccuggagaaggccgccgagguguccugggaggaggaggcggagcacagcggcgccucccacaacauccugguggagguccaggacgacgggaccaugaagaucaaggacgaggagcgcgacgacacccucacgauccugcugaaggccacccuccuggccgugagcggcguguacccgauguccauccccgccacccuguucgucugguacuucuggcagaagaagaagcagcggagcggggugcucugggacacccccagcccgcccgagguggagcgcgcgguccuggacgacggcaucuaccggauccugcagcgcggccugcucgggcggagccaggugggcgugggggucuuccaggacggcguguuccacacgauguggcacgugacccgcggggccguccugauguaccagggcaagcggcuggagcccuccugggccagcgugaagaaggaccucaucuccuacggcgggggcuggcgcuuccaggggagcuggaacaccggcgaggaggugcaggucaucgccguggagcccgggaagaaccccaagaacgugcagaccacgcccggcaccuucaagacccccgagggcgaggucggggccaucgcgcuggacuucaagcccggcaccuccgggagccccaucgugaaccgggagggcaagaucgugggccuguacgggaacggcgucgugacgaccuccgggaccuacgugagcgccaucgcccaggccaaggccagccaggagggcccgcuccccgagaucgaggacgaggucuucaagaagcgcaaccugaccaucauggaccugcaccccggguccggcaagacgcggcgcuaccucccggcgaucgugcgggaggccaucaagcgcaagcugcgcacccugauccucgcccccacccggguggucgccagcgagauggcggaggcccugaagggcaugcccauccgcuaccagaccacggccgugaaguccgagcacaccgggcgggagaucguggaccugaugugccacgccaccuucaccaugcgccuccugagccccguccgggugccgaacuacaacaugaucaucauggacgaggcccacuucacggaccccgcguccaucgccgcccgcggcuacaucagcacccggguggggaugggcgaggccgccgcgaucuucaugaccgccacgccgcccggguccgucgaggccuucccgcagagcaacgccgugauccaggacgaggagcgcgacauccccgagcgguccuggaacagcggcuacgacuggaucacggacuuccccggcaagaccgugugguucguccccuccaucaagagcgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggcgaacuuccgggccgaccgcgugaucgacccgcggcgcugccugaagcccgugauccugaaggacggccccgagcgggucauccucgccgggcccaugccggugaccgucgccuccgcggcccagcgccggggccgcaucggccgcaaccagaacaaggagggggaccaguacaucuacaugggccagccccugaacaacgacgaggaccacgcccacuggacggaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggacguacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccgugcucaccgggggcgucacgcuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagacgaccaagaaggaccucggcaucgggcacguggucgccgagaaccaccaccacgccaccaugcuggacaucgaccugcaccccgccuccgcguggacccucuacgccguggccacgaccaucaucaccccgaugaugcggcacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggccgcggugcucaugcugguggcccacuacgccaucaucgggccgggccugcaggccaaggcgacccgcgaggcccagaagcgcaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcugagcaagagcgaguucaacaccuacaagcgcuccggcaucauggagguggaccggagcgaggccaaggaggggcucaagcgcggcgagacgaccaagcacgcggucucccgggggaccgccaagcugcgcugguucguggagcggaaccuggugcgccccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcuguacuccgggaaggacguguucuucacgccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugacgucccgcaugcuccugaaccgcuucaccauggcccaccggaagcccaccuacgagcgcgacguggaccugggcgccggcacccggcacguggccgucgagcccgagaucgccaaccucgacaucaucgggcagcgcaucgagaacaucaagaacgagcacaagagcacguggcacuacgacgaggacaaccccuacaagaccugggcguaccacggcuccuacgaggugaagccgagcggguccgccagcuccauggugaacggcgucgugcggcugcugaccaagcccugggacgucauccccauggugacccagaucgccaugacggacaccacccccuucgggcagcagcgcguguucaaggagaaggucgacacccggacgccgcgccccaagcggggcaccgcccagaucauggaggugaccgccaaguggcucuggggcuuccugagccgcaacaagaagccccggaucugcacccgcgaggaguucacgcggaaggugcgcagcaacgcggccaucggggccgucuucguggacgagaaccaguggaacuccgccaaggaggccguggaggacgagaaguucugggaccugguccaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagaucccgggcggcaacauguacgccgacgacaccgccgggugggacacccgcaucacggaggacgaccuccagaacgaggccaagaucaccgacaucauggagcccgagcacgcccugcuggcgaccuccaucuucaagcucaccuaccagaacaaggucgugcgcgugcagcggcccgccaagagcggcacggucauggacgugaucucccgccgggaccagcgcgggagcggccaggugggcaccuacgggcugaacaccuucaccaacauggagguccagcugauccggcagauggaguccgagggcaucuucagccccuccgagcucgagaacagcaaccuggccgagcgcgugcuggacuggcucgagaagcacgggguggagcggcugaagcgcauggccaucuccggcgacgacugcgucgugaagccgacggacgaccgguucgccaccgcgcugaccgcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgccgugcccgucgacugggugcccacgucccggaccaccuggagcauccacgcgcaccaccaguggaugaccaccgaggacaugcuguccguguggaaccgcgucuggaucgaggagaaccccuggauggaggacaagacgcacgugagcuccugggaggacgugccguaccucgggaagcgcgaggaccaguggugcggcagccugaucggccugaccgcccgggccaccugggccaccaacauccaggucgcgaucaaccaggugcgccggcucaucgggaacgagaacuaccuggacuacaugacguccaugaagcgcuucaagaacgagagcgaccccgagggcgcccugugguga

SEQ ID NO: 8854 - RNA, 9879 nt, Artificial Sequence
  derived and/or modified CDS sequence (opt1) from DENV-1__KP406802__SS-prME
agcgugaccaugcugcucaugcugaugcccaccgcccuggccuuccaccucaccacccggggcggggagccccacaugaucgugagcaagcaggagcggggcaagagccugcuguucaagaccagcgcggggaucaacaugugcacccucaucgccauggaccugggcgagcugugcgaggacacccucaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcggguggagaccugggcccugcgccaccccggguucacggucaucgcccuguuccucgcgcacgccaucggcaccagcaucacccagaaggggaucaucuucauccugcugaugcucgugacccccuccauggccaugcggugcgugggcaucggcagccgcgacuucgucgaggggcuguccggcgccacguggguggacgugguccuggagcacgggagcugcgugaccaccauggccaaggacaagcccacccucgacaucgagcugcugaagacggaggugaccaaccccgcgguccuccggaagcugugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccugaucacgugcgccaaguucaagugcgugaccaagcuggagggcaagaucgugcaguacgagaaccucaaguacagcgucaucgugaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcugguccacaagcagugguuccuggaccucccccugcccuggaccagcggggccagcaccucccaggagaucuggaaccggcaggaccugcucgugacguucaagaccgcccacgcgaagaagcaggagguggucgugcugggcagccaggagggcgccaugcacaccgcccugaccggggccacggagauccagaccuccggcaccaccacgaucuucgccgggcaccucaagugccgccugaagauggacaagcugacccucaagggcaugagcuacgugaugugcaccggguccuucaagcuggagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccucaagcugagcugguucaagaagggguccagcaucggcaagauguucgaggccaccgcccgcggggcccggcgcauggcgauccugggcgacaccgccugggacuucggguccaucggcggcguguucacgagcguggggaagcucguccaccagaucuucggcaccgccuacggggugcuguucuccggcgugagcuggaccaugaagaucgggaucggcguccugcucaccuggcugggccugaacucccgcagcacgucccucagcaugaccugcaucgccguggggcuggugacccuguaccucggcgucauggugcaggccgacuccgggugcgugaucaacuggaagggccgggagcugaagugcgggagcggcaucuucgucaccaacgaggugcacacguggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggagcacaaguacagcuggaaguccuggggcaaggccaagaucaucggcgccgacgugcagaacaccacguucaucaucgacgggcccaacaccccggagugccccgacgaccagcgcgcguggaacaucugggagguggaggacuacggcuucgggaucuucaccaccaacaucuggcugaagcuccgggacagcuacacgcaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacccucuggagcaacggcguccuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguucuuccuccugaucauggggcagcugaccuggaacgaccucauccgccugugcaucauggugggcgcgaacgccagcgaccgcauggggaugggcacgaccuaccuggcccucauggccaccuucaagaugcggccgauguucgccgucggccugcuguuccgccggcucaccucccgcgaggugcugcugcucacgaucgggcugagccugguggcguccgucgagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgccuggaagaccauggcgauggugcucagcaucgucucccuguucccccugugccucagcaccacgucccagaagaccaccuggcugcccgugcugcucggcagccuggggugcaagccgcugaccauguuccucaucgccgagaacaagaucuggggccggaaguccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggacgaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacgcccagcccgcccgagguggagcgcgccgugcuggacgacggcaucuaccggaucaugcagcgcggccugcucgggcggucccaggucggcguggggguguuccaggagaacgucuuccacaccauguggcacgugacccgcggcgcggugcugauguaccaggggaagcggcuggagcccagcugggccuccgucaagaaggaccucaucagcuacggcggcggguggcgccugcagggcuccuggaacaccggggaggagguccaggugaucgccgucgagcccggcaagaaccccaagaacgugcagacggcccccgggaccuucaagacccccgagggcgaggugggcgccaucgcgcuggacuucaagcccgggaccagcggcucccccaucgucaaccgggaggggaagaucgugggccucuacggcaacgggguggucacgaccagcggcaccuacgugagcgccaucgcccaggccaaggcgucccaggaggggccgcugcccgagaucgaggacgagguguuccgcaagcggaaccugaccaucauggaccuccaccccggcagcgggaagacgcgccgguaccugccggccaucguccgcgaggccaucaagcggaagcugcgcacccucauccuggcccccacccgcgugguggccuccgagauggcggaggcccugaagggcaugcccauccgguaccagaccacggccgucaagagcgagcacaccggcaaggagaucguggaccucaugugccacgccaccuucaccaugcgccugcugucccccgugcgggucccgaacuacaacaugaucaucauggacgaggcccacuucacggaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgccaacugccuccgcaagaacgggaagcgggucauccagcugucccgcaagaccuucgacaccgaguaccagaagacgaagaacaacgacugggacuacguggugaccaccgacaucagcgagaugggcgcgaacuuccgggccgaccgcgucaucgacccgcggcgcugccugaagcccgugauccucaaggacgggcccgagcgggugauccuggccggccccaugccggucaccguggccuccgccgcgcagcgccgggggcgcgucggccggaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggacguacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacccugaugcuccuggcccugaucgccgugcucacgggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucaccccgaugaugcggcacaccaucgagaacaccacggccaacaucagccugaccgccaucgcgaaccaggccgccauccugauggggcucgacaagggcuggcccaucuccaagauggacaucggcgucccccugcuggcccucgggugcuacagccaggugaacccccugacccugaccgcggccgugcucaugcuggucgcccacuacgccaucaucggcccggggcugcaggccaaggcgacgcgcgaggcccagaagcgcaccgccgccggcaucaugaagaaccccaccguggacgggaucguggccaucgaccucgaccccgucguguacgacgcgaaguucgagaagcagcugggccagaucaugcugcucauccugugcaccucccagauccugcucaugcggacgaccugggcccugugcgagagcaucacccuggccaccggcccccucacgacccugugggagggguccccgggcaaguucuggaacaccaccaucgccgugagcauggccaacaucuuccgcggguccuaccuggcgggcgccggccucgccuucagccugaugaagucccucgggggcgggcggcgcgggacgggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagaccacgaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccacguacggguggaaccuggugaagcugcacuccggcaaggacguguucuucaucccgcccgagaagugcgacacccuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacgcucgagcagaugcagcgcaagcacggcggcaugcuggugcggaacccgcugucccgcaacagcacccacgagauguacuggguguccugcgggaccggcaacaucgucagcgcggugaacaugaccucccggaugcuccugaaccgcuucaccauggcccaccgcaagcccacguacgagcgggacguggaccugggggccggcacccgccacgucgccguggagcccgagguggccaaccucgacaucaucggccagcggaucgagaacaucaagcacgagcacaagagcaccuggcacuacgacgaggacaaccccuacaagaccugggcguaccacggguccuacgaggucaagccgagcggcuccgccagcagcauggugaacggggucgugaagcugcugacgaagcccugggacgugauccccauggucacccagaucgccaugaccgacaccacgcccuucggccagcagcgcguguucaaggagaagguggacacccggaccccgaaggccaagcgcgggaccacgcagaucauggaggucaccgcccgguggcucuggggcuuccugucccgcaacaagaagccccggaucugcacccgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgccacgugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucaccgaggacgaccuccagaacgaggccaagaucacggacaucauggagccggagcacgcccugcuggcgaaggccaucuucaagcucaccuaccagaacaaggugguccgcgugcagcgccccgccaagaacgggaccgugauggacgucaucucccggcgcgaccagcggggcagcggccagguggggaccuacggccugaacacguucaccaacauggaggcccagcugauccgccagauggaguccgaggggaucuucagccccuccgagcucgagacccccaaccuggccgagcgggugcuggacuggcucgagaaguacggcgucgagcgccugaagcggauggcgaucagcggggacgacugcguggugaagccgaucgacgaccgcuucgccaccgcccugacggcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugucccagggggcgggcuggagccuccgcgagaccgccugccugggcaagagcuacgcccagauguggcagcugauguacuuccaccggcgcgaccuccggcuggccgcgaacgccaucugcuccgccguccccguggacugggugcccaccagccgcaccacgugguccauccacgcccaccaccaguggaugaccaccgaggacaugcugagcgucuggaaccggguguggaucgaggagaaccccuggauggaggacaagacccacaucuccagcugggaggacgugccguaccucggcaagcgcgaggaccaguggugcgggucccugaucggccugacggcccgcgcgaccugggccaccaacauccaggucgccaucaaccaggugcggcgccucaucggcaacgagaacuaccuggacuacaugaccagcaugaagcgguucaagaacgaguccgaccccgagggggcccugugguga

SEQ ID NO: 8855 - RNA, 9879 nt, Artificial Sequence
  derived and/or modified CDS sequence (opt1) from DENV-1__KP406803__SS-prME
agcgugaccaugcugcucaugcugcugcccaccgcccucgccuuccaccugaccacccgcggcggggagccccacaugaucgugagcaagcaggagcggggcaagagccugcuguucaagaccuccgccggggugaacaugugcacccugaucgccauggaccugggcgagcucugcgaggacaccaugaccuacaagugcccccggaucaccgagaccgagcccgacgacguggacugcuggugcaacgccaccgagaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacacgaacuucgucugccggcgcaccuucguggaccggggcugggggaacggcugcggccuguucggcaaggggagccugaucacgugcgccaaguucaagugcgugaccaagcuggagggcaagaucguccaguacgagaaccucaaguacuccgugaucgugacgguccacaccggcgaccagcaccagguggggaacgagaccaccgagcacggcaccacggccaccaucacgccccaggcccccaccagcgagauccagcugacggacuacggggcgcugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcccacgccaagaagcaggaggucguggugcugggcucccaggagggcgccaugcacaccgcgcugaccggggccaccgagauccagacgagcggcaccaccaccaucuucgccgggcaccucaagugccgccugaagauggacaagcugacgcucaagggcgucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcugaucaccgcgaacccgaucgugaccgacaaggagaagcccgugaacaucgaggccgagccgcccuucggggaguccuaccucgucgugggcgccggcgagaaggcccugaagcugagcugguucaagaagggguccagcaucggcaagauguucgaggcgacggcccgcggggcccggcgcauggccauccucggcgacaccgccugggacuucggguccaucggcggcguguucaccagcgucgggaagcugauccaccagaucuucggcaccgcguacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccuguccgccgcgaucggcaaggccugggaggagggggugugcggcauccggagcgccacccgccucgagaacaucauguggaagcagaucuccaacgagcugaaccacauccugcucgagaacgacaugaaguucacgguggucgugggggacgugaacggcauccuggcccaggggaagaagaugauccggccccagcccauggagcacaaguacagcuggaaguccuggggcaaggccaaggucaucggcgcggacgugcagaacaucaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgccgccaucaaggacagcaaggcggugcacgccgacaugggcuacuggaucgaguccgagaagaacgagaccuggaagcugacccgggccagcuucaucgaggugaagacgugcgucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucggccugugcgagggcacgaccguggucguggacgagcacugcgggaaccggggcccgucccuccgcaccaccacggugaccgggaagaucauccacgaguggugcugccggagcugcacccugccgccccugcgcuucaagggcgaggacgggugcugguacggcauggagauccggcccgucaaggagaaggaggagaaccucgugaaguccauggugagcgccggcagcggggaggucgacuccuucagccugggccugcucugcaucuccaucaugaucgaggaggugaugcgcagccgguggucccgcaagaugcugaugaccgggacgcuggcgguguuccuccugcugaucaugggccagcucaccuggaacgaccugauccggcugugcaucauggucggggccaacgccagcgacaagaugggcaugggcaccaccuaccucgcccugauggccacguuccgcaugcgcccgauguucgcgguggggcuccucuuccggcgccugaccucccgggagguccugcuccugaccgugggccugagccucguggccuccgucgagcugcccaacagccuggaggagcucggggacggccuggccaugggcaucaugaugcugaagcuccugaccgacuuccagucccaccagcugugggccgcccuccugagccugacguucgugaagaccaccuucucccuccacuacgcguggaagaccauggccaugauccugagcaucgugucccuguucccccucugccugagcacgaccucccagaagaccaccuggcugcccguccuccuggggagccugggcugcaagccgcucacgauguuccugaucaccgagaacaagaucugggggcgcaaguccuggccccugaacgagggcaucauggccguggggaucgugagcauccuccugagcucccugcucaagaacgacgucccccuggccggcccccugaucgcgggcgggaugcucaucgccugcuacgugaucagcggcuccagcgccgaccugucccuggagaaggccgccgaggugagcugggaggaggaggcggagcacuccggggccagccacaacauccucgucgaggugcaggacgacggcaccaugaagaucaaggacgaggagcgggacgacacccugaccauccugcucaaggccacgcugcuggccaucuccgggguguacccgaugagcauccccgccacccucuucgucugguacuucuggcagaagaagaagcagcgcuccggcgugcugugggacacccccagcccgcccgagguggagcgggcgguccuggacgacggcaucuaccgcauccugcagcgggggcuccugggcaagucccaggugggggugggcgucuuccaggaggggguguuccacaccauguggcacgugacgcgcggcgccguccugauguaccagggcaagcggcucgagcccagcugggccuccgugaagaaggaccugaucagcuacgggggcggguggcgcuuccagggcuccuggaacaccggggaggaggugcaggucaucgccguggagcccggcaagaaccccaagaacgugcagaccgcccccggcaccuucaagacgcccgagggggaggucggcgcgaucgcccuggacuucaagcccgggaccagcggcucccccaucgugaaccgggagggcaagaucguggggcucuacggcaacggggucgugaccaccagcggcacguacgugagcgccaucgcccaggccaaggcgucccaggaggggccgcugcccgagaucgaggacgaggucuuccgcaagcggaaccugaccaucauggaccuccaccccggcagcggcaagacccgccgguaccugccggccaucgugcgcgaggccaucaagcggaagcugcgcacccucgugcuggcccccacgcgggucguggcguccgagauggccgaggcccugaaggggauccccauccgcuaccagaccaccgccgucaagagcgagcacaccggcaaggagaucgucgaccucaugugccacgccacguucaccaugcgccugcugucccccgugcgggugccgaacuacaacaugaucaucauggacgaggcgcacuucaccgaccccgccagcaucgccgcccgcggguacaucuccacccgggucggcaugggggaggccgcggccaucuucaugacggccacgccgcccggcagcauggaggccuucccgcaguccaacgccgcgauccaggacgaggagcgcgacauccccgagcggagcuggaacuccggcuacgacuggaucaccgacuuccccgggaagaccgugugguucgugcccagcaucaaguccggcaacgacaucgccaacugccuccgcaagaacgggaagcgggucgugcagcugagccgcaagacguucgacaccgaguaccagaagaccaagaacaacgacugggacuacguggucaccacggacaucuccgagaugggcgccaacuuccgggccgaccgcgugaucgacccgcggcgcugccugaagcccgucauccucaaggacgggcccgagcgggugauccuggcgggccccaugccggugaccgucgccagcgccgcccagcgccggggccgcaucgggcggaaccagaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgcgagaaguccgccgccaucgacggggaguaccggcuccgcggcgaggcccgcaagacguucguggagcugaugcggcgcggcgaccugcccguguggcucagcuacaaggucgcguccgagggguuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacagcgacccccuggcccugcgcgaguucaaggaguucgccgccggccggcgcuccgucagcggcgaccucauccuggagaucgggaagcugccgcagcaccucacccagcgggcgcagaacgcccuggacaaccuggugaugcuccacaacuccgagcagggcgggaaggccuaccgccacgccauggaggagcugcccgacacgaucgagacccugaugcuccuggcgcugaucgccgugcucaccggcggggucacccuguucuuccugagcggccggggccucgggaagaccuccaucggccugcugugcgugauggccagcuccgcccuccuguggauggccagcguggagccccacuggaucgcggccuccaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcggccgagagccaccaccacgccgccaugcuggacguggaccugcaccccgccuccgcguggacgcucuacgccgucgccaccaccaucaucaccccgaugaugcgccacacgaucgagaacaccaccgccaacaucagccugaccgccaucgcgaaccaggccgccauccugaugggccucgacaagggguggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgggaggcccagaagcgcaccgccgccggcaucaugaagaaccccacgguggacggcaucgucgccaucgaccucgaccccgugguguacgacgcgaaguucgagaagcagcuggggcagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgucagcauggccaacaucuuccgcggcuccuaccuggcgggggccggccucgccuucagccugaugaagucccucgggggcgggcgccgggggaccggcgcccagggggagacccucggcgagaaguggaagcgccagcugaaccagcuguccaagagcgaguucaacacguacaagcgguccgggaucaucgagguggaccgcagcgaggcgaaggagggccucaagcgcggggagaccaccaagcacgccgugucccgcggcaccgccaagcugcggugguucgucgagcgcaaccuggugaagcccgagggcaaggugaucgaccuggggugcggccgcggcggguggagcuacuacugcgccgggcucaagaaggucacggaggugaagggguacaccaagggcgggcccggccacgaggagcccaucccgauggccaccuacggguggaaccuggugaagcuguacuccggcaaggacgucuucuucacgccgcccgagaagugcgacacgcuccugugcgacaucggggagagcucccccaacccgaccaucgaggagggccgcacccugcgggugcuccgcaugguggagcccuggcugcggggcaaccaguucugcaucaagguccugaaccccuacaugcccagcgugguggagacccucgagcagaugcagcgcaagcacgggggcaugcugguccggaacccgcugucccgcaacagcacccacgagauguacuggguguccugcgggacgggcaacaucgugagcgcggucaacaugaccucccggaugcuccugaaccgcuucaccauggcccaccggaagcccaccuacgagcgcgacguggaccugggcgccgggacgcgccacguggccgucgagcccgagguggccaaccucgacaucaucggccagcggaucgagaacaucaagaacgagcacaagagcaccuggcacuacgacgaggacaaccccuacaagaccugggcguaccacggguccuacgaggucaagccgagcggcuccgccagcagcauggugaacggggugguccgccugcugaccaagcccugggacgugauccccauggugacgcagaucgccaugaccgacaccacccccuucggccagcagcgggucuucaaggagaagguggacacgcgcaccccgaaggccaagcggggcaccgcccagaucauggaggugaccgcgcgcuggcucuggggguuccugucccggaacaagaagccccgcaucugcacgcgggaggaguucacccgcaagguccggagcaacgccgccaucggcgccguguucguggacgagaaccaguggaacuccgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaagggcagccgcgccaucugguacauguggcugggggcgcgguuccucgaguucgaggcccugggcuucaugaacgaggaccacugguucucccgcgagaacagccuguccggggucgagggcgaggggcuccacaagcugggcuacauccugcgggacaucagcaagauccccggcgggaacauguacgccgacgacaccgccggcugggacacgcgcaucaccgaggacgaccuccagaacgaggccaagaucaccgacaucauggagccggagcacgcgcugcuggccaccuccaucuucaagcucacguaccagaacaagguggugcggguccagcgccccgccaagaacgggaccgugauggacgugaucagccgccgggaccagcgcggcuccggccaggucgggaccuacggccugaacaccuucacgaacauggaggcccagcugauccggcagauggagagcgaggggaucuuccuccccuccgagcuggagacccccaaccuggccgagcgcgugcucgacuggcuggagaaguacggcaucgagcggcugaagcgcauggcgaucagcggggacgacugcguggucaagccgaucgacgaccgguucgccaccgcccucaccgcccugaacgacaugggcaaggugcgcaaggacaucccccagugggagcccuccaagggcuggaacgacuggcagcagguccccuucugcagccaccacuuccaccagcugaucaugaaggacgggcgggagaucgucgugccgugccgcaaccaggacgagcucgugggccgggcccgcgucucccagggggcgggcuggagccugcgggagacggccugccugggcaagagcuacgcccagauguggcagcucauguacuuccaccgccgggaccugcgccuggccgcgaacgccaucugcuccgccgugcccguggacuggguccccaccagccggaccaccugguccauccacgcccaccaccaguggaugacgaccgaggacaugcucagcguguggaaccgcguguggaucgaggagaaccccuggauggaggacaagacccacgucuccagcugggaggacgugccguaccugggcaagcgggaggaccaguggugcggcucccugaucgggcucaccgcccgcgcgaccugggccacgaacauccagguggccaucaaccagguccgccggcugaucggcaacgagaacuaccuggacuacaugaccagcaugaagcgcuucaagaacgaguccgaccccgagggggcccucugguga

SEQ ID NO: 8856 - RNA, 9879 nt, Artificial Sequence
  derived and/or modified CDS sequence (opt1) from DENV-1__KJ438293__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaugacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagaucagcugguucaagaagggguccagcaucggcaagauguucgaggccaccgcccgcggggcccggcgcauggcgauccucggcgacacggccugggacuucggguccaucggcggcguguucaccagcguggggaagcugguccaccagaucuucggcaccgccuacggggugcuguucuccggcgugagcuggaccaugaagaucgggaucggcguccuccugacguggcugggccucaacucccgcagcaccucccugagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcucaagcugcgggacagcuacacccaggucugcgaccaccgccugauguccgccgccaucaaggacagcaaggccgugcacgccgacaugggcuacuggaucgaguccgagaagaacgagaccuggaagcucgcgcgggccagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccugcgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacccucgccguguucuuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccgucggccuccuguuccgccggcugacgucccgcgaggugcugcuccugaccaucgggcugagccucguggcguccgucgagcugcccaacagccuggaggagcucggcgacgggcuggccaugggcaucaugauccugaagcuccugaccggcuuccagucccaccagcugugggccacccuccugagccugacguucaucaagaccaccuucucccuccacuacgccuggaagaccauggcgauggugcugagcaucgucucccuguucccccucugccugagcacgaccucccagaagaccaccuggcugcccgugcuccuggggagccugggcugcaagccgcucacgauguuccugaucaccgagaacaagaucugggggcggaaguccuggccccugaacgagggcaucauggccguggggaucgucagcauccuccugagcucccugcucaagaacgacgugccccuggccggcccccugaucgccggcgggaugcucaucgccugcuacgugaucagcggcuccagcgcggaccugucccuggagaaggccgccgaggucagcugggaggaggaggccgagcacuccggggccagccacaacauccucguggaggugcaggacgacggcaccaugaagaucaaggacgaggagcgcgacgacacccugaccauccugcucaaggcgacgcugcuggccgucuccgggguguacccgcucagcauccccgccacccuguucgugugguacuucuggcagaagaagaagcagcgguccggcguccugugggacacccccagcccgcccgagguggagcgcgccgugcucgacgacggcaucuaccggaucaugcagcgcgggcugcugggccggucccaggucggggugggcguguuccaggagaacgucuuccacaccauguggcacgugacgcgcggggccgugcugauguaccagggcaagcggcucgagcccagcugggcguccgucaagaaggaccugaucagcuacggcgggggcuggcgccugcagggguccuggaacaccggcgaggagguccaggugaucgccgucgagcccgggaagaaccccaagaacgugcagaccgcccccggcaccuucaagacgcccgagggcgaggugggggccaucgcccucgacuucaagcccggcaccagcgggucccccaucgucaaccgggagggcaagaucgugggccuguacgggaacggcguggucaccaccagcgggacguacgugagcgcgaucgcccaggccaaggccucccaggagggcccgcugcccgagaucgaggacgagguguuccgcaagcggaaccucaccaucauggaccugcaccccgggagcggcaagacccgccgguaccugccggcgaucguccgcgaggccaucaagcggaagcuccgcacccugauccuggcccccacgcgcgugguggccuccgagauggccgaggcgcucaagggcaugcccauccgguaccagaccaccgccgucaagagcgagcacaccgggaaggagaucguggaccugaugugccacgccacguucaccaugcgccugcucucccccgugcgggucccgaacuacaacaugaucaucauggacgaggcccacuucaccgaccccagcuccaucgccgcgcgcggcuacaucagcacccggguggggaugggcgaggccgccgccaucuucaugacggccacgccgcccggguccguggaggcguucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcugucccgcaagacguucgacaccgaguaccagaagaccaagaacaacgacugggacuacguggugaccacggacaucagcgagaugggggccaacuuccgggcggaccgcgucaucgacccgcggcgcugccucaagcccgugauccugaaggacggccccgagcgggugguccuggccgggcccaugccggugaccgucgccuccgccgcccagcgccggggccgcaucggccggaaccacaacaaggagggggaccaguacaucuacaugggccagccccucaacaacgacgaggaccacgcgcacuggaccgaggccaagaugcugcuggacaacaucaacacccccgaggggaucauccccgcccucuucgagccggagcgcgagaaguccgccgccaucgacggcgaguaccgccugcgcggggaggcgcgcaagacguucguggagcugaugcggcgcggcgaccuccccguguggcuguccuacaaggucgccagcgagggcuuccaguacagcgaccggcgcuggugcuucgacggggagcggaacaaccaggugcuggaggagaacauggacguggagaucuggaccaaggagggcgagcgcaagaagcuccggccccgcuggcuggacgcccggaccuacuccgacccccuggcccuccgcgaguucaaggaguucgccgcggggcggcgcagcgucuccggcgaccugauccuggagaucggcaagcucccgcagcaccugacccagcgggcccagaacgcccuggacaaccucgugaugcugcacaacagcgagcagggcgggcgcgccuaccggcacgcgauggaggagcugcccgacacgaucgagacccucaugcugcuggcccucaucgccgugcugaccgggggcgucacccuguucuuccucuccgggcgcggccugggcaagaccagcaucgggcugcucugcgugauggccuccagcgugcugcuguggaucgccuccgucgagccccacuggaucgcggccagcaucauccucgaguucuuccugauggugcugcucauccccgagccggaccggcagcgcacgccccaggacaaccagcuggccuacguggucaucggccuccucuucaugauccugaccguggccgccaacgagauggggcugcucgagaccaccaagaaggaccugggcaucgggcacguggcggucgagaaccaccaccacgccgccauccuggacguggaccuccaccccgccuccgccuggacgcuguacgcgguggccaccaccaucaucaccccgaugaugcggcacacgaucgagaacaccaccgccaacaucagccugaccgccaucgccaaccaggcggccauccucaugggccuggacaagggcuggcccaucuccaagauggacaucggggucccccugcucgcccugggcugcuacagccaggugaacccccugacgcucaccgccgcggugcugaugcuggucgcccacuacgccaucaucgggccgggccuccaggccaaggccacccgcgaggcgcagaagcgcaccgccgccgggaucaugaagaaccccacgguggacggcaucguggccaucgaccuggaccccgucguguacgacgccaaguucgagaagcagcugggccagaucaugcuccugauccugugcaccucccagauccuccugaugcggaccaccugggcgcugugcgagagcaucacgcucgccaccgggccccugaccacccugugggagggcuccccggggaaguucuggaacacgaccaucgccgugagcauggccaacaucuuccgcggcuccuaccucgccggcgcggggcuggccuucagccugaugaagucccucggcgggggccggcgcgggaccggcgcccagggcgagacccugggggagaaguggaagcggcagcugaaccagcucuccaagagcgaguucaacacguacaagcgcuccggcaucauggaggucgaccggagcgaggccaaggaggggcugaagcgcggcgagaccaccaagcacgcggugucccgggggaccgccaagcugcgcugguucguggagcggaaccucgucaagcccgagggcaaggugaucgaccugggcugcgggcgcggcggguggagcuacuacugcgccggccugaagaaggugacggaggucaagggguacaccaagggcggccccgggcacgaggagcccaucccgauggccaccuacggcuggaaccuggugaagcucuacuccgggaaggacguguucuucaucccgcccgagaagugcgacacccugcugugcgacaucggcgagagcucccccaacccgacgaucgaggaggggcggacccuccgcguccugaagaugguggagcccuggcugcggggcaaccaguucugcaucaagauccucaaccccuacaugcccagcguggucgagacccuggagcagaugcagcgcaagcacggcgggaugcuggugcggaacccgcucucccgcaacagcacccacgagauguacuggaucuccugcggcaccgggaacaucgugagcgccgucaacaugacgucccggaugcugcugaaccgcuucaccauggcgcaccgcaagcccaccuacgagcgggacguggaccucggcgccggcacccgccacguggccgucgagcccgagguggccaaccuggacaucaucgggcagcggaucgagaacaucaagcacgagcacaagagcacguggcacuacgacgaggacaaccccuacaagaccugggccuaccacggcuccuacgaggugaagccgagcggguccgcgagcagcauggucaacggcguggucaagcugcucaccaagcccugggacgugauccccauggugacccagaucgccaugacggacaccacccccuucgggcagcagcgcgucuucaaggagaagguggacacccggacgccgaaggccaagcgcggcaccgcccagaucauggaggugaccgcccgguggcuguggggcuuccugucccgcaacaagaagccccggaucugcacccgcgaggaguucacgcggaagguccgcagcaacgcggccaucggggccguguucguggacgagaaccaguggaacuccgccaaggaggcggucgaggacgagcgguucugggaccucgugcaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcgucgagggggagggccugcacaagcugggguacauccuccgcgacaucagcaagauccccggcggcaacauguacgccgacgacaccgccgggugggacacccggaucacggaggacgaccugcagaacgaggccaagaucaccgacaucauggagccggagcacgcccugcucgcgaaggccaucuucaagcugaccuaccagaacaagguggugcgcguccagcgccccgccaagaacggcaccgugauggacgugaucucccggcgcgaccagcgggggagcggccaggucggcacguacgggcugaacaccuucaccaacauggaggcccagcucauccgccagauggaguccgagggcaucuucagccccuccgagcuggagacccccaaccuggccgagcgggugcucgacuggcuggagaaguacgggguggagcgccugaagcggauggcgaucagcggcgacgacugcgucgugaagccgaucgacgaccgcuucgccacggcccucaccgcccugaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcucgucgggcgcgcccgggugucccagggcgcgggguggagccugcgcgagaccgccugccugggcaagagcuacgcccagauguggcagcucauguacuuccaccggcgcgaccugcggcuggccgcgaacgccaucugcuccgccgugcccgucgacugggugcccaccagccgcacgaccugguccauccacgcccaccaccaguggaugaccaccgaggacaugcucagcguguggaaccgggucuggaucgaggagaaccccuggauggaggacaagacgcacaucuccagcugggaggacgugccguaccuggggaagcgcgaggaccaguggugcggcucccugaucggccucaccgcccgcgcgaccugggccaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8857 - RNA, 9879 nt, Artificial Sequence
  derived and/or modified CDS sequence (opt1) from DENV-1__KJ438296__SS-prME
agcgugaccaugcugcucaugcugaugcccaccgcccuggccuuccaccucaccacccggggcggggagccccacaugauggugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaucggcacccuggccguguucuuccugcucaucauggggcagcugaccuggaacgaccugauccgccucugcaucauggucggcgcgaacgccagcgaccgcauggggaugggcacgaccuaccuggcccugauggccaccuucaagaugcggccgauguucgccgugggccuccuguuccgccggcugaccucccgcgaggugcuccugcugacgaucgggcucagccuggucgcguccgccgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucaucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgcgacgacacccugaccauccuccugaaggccacccugcucgccgucuccggcguguucccgcugagcauccccgccacccuguucgugugguacuucuggcagaagaagaagcagcgguccgggguccucugggacacgcccagcccgcccgagguggagcgcgcggugcuggacgacggcaucuaccggaucaugcagcgcggccugcuggggcggucccaggucggcguggggguguuccaggagaacgucuuccacaccauguggcacgugacccgcggcgccgugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgggaggggaagaucgugggccuguacggcaacgggguggucacgaccagcggcaccuacgugagcgccaucgcccaggcgaaggccucccaggaggggccgcuccccgagaucgaggacgagguguuccgcaagcggaaccugaccaucauggaccugcaccccggcagcgggaagacgcgccgguaccucccggccaucguccgcgaggccaucaagcggaagcugcgcacccugauccucgcccccacccgcgugguggcguccgagauggccgaggcccugaagggcaugcccauccgguaccagaccacggccgucaagagcgagcacaccggcaaggagaucguggaccugaugugccacgccaccuucaccaugcgccuccugucccccgugcgggucccgaacuacaacaugaucaucauggacgaggcgcacuucacggaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgcgaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucaccguggccuccgcggcccagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcgcugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugacgggcggggugacccucuucuuccuguccggccgcgggcugggcaagaccagcaucggccuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcguccgccuggacccuguacgccguggccaccacgaucaucaccccgaugaugcggcacaccaucgagaacaccacggccaacaucagccucaccgcgaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgccaucaucggcccggggcugcaggcgaaggccacgcgcgaggcccagaagcgcaccgccgccggcaucaugaagaaccccaccgucgacgggaucguggcgaucgaccuggaccccguggucuacgacgccaaguucgagaagcagcucggccagaucaugcugcugauccucugcaccucccagauccugcugaugcggacgaccugggcccucugcgagagcaucacccuggccaccggcccccugacgacccucugggagggguccccgggcaaguucuggaacaccaccaucgccgugagcauggcgaacaucuuccgcggguccuaccuggccggcgccggccuggccuucagccucaugaagucccucgggggcgggcggcgcgggacgggggcgcagggcgagacccugggcgagaaguggaagcggcgccucaaccagcuguccaagagcgaguucaacaccuacaagcgguccgggaucauggagguggaccgcagcgaggccaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggcgacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccggaacagcacccacgagauguacuggguguccugcgggaccggcaacaucgugagcgccgucaacaugaccucccgcaugcugcucaaccgcuucaccauggcccaccggaagcccacguacgagcgcgacguggaccugggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcgcagaucauggaggugacggcccgcuggcuguggggcuuccucucccggaacaagaagccccgcaucugcacccgggaggaguucacccgcaagguccggagcaacgccgccaucggcgcgguguucaucgacgagaaccaguggaacuccgccaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcgaagaucaccgacaucauggagccggagcacgcccuccuggccaaggccaucuucaagcugacguaccagaacaaggucgugcgcgugcagcggcccgccaagaacgggaccgucauggacgugaucucccgccgggaccagcgcggcagcggccagguggggaccuacggccucaacaccuucacgaacauggaggcgcagcugauccggcagauggaguccgaggggaucuucagccccuccgagcuggagacccccaaccucgccgagcgcguccuggacuggcugggcaaguacgggguggagcggcucaagcgcauggccaucagcggcgacgacugcguggucaagccgaucgacgaccgguucgccaccgcccugaccgcgcugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacaucuccaacugggaggacgucccguaccuggggaagcgcgaggaccaguggugcggcagccucaucggccugaccgcccgggccacgugggccaccaacauccagguggccaucaaccaggugcgccggcugaucgggaacgagaacuaccucgacuacaugaccuccaugaagcgcuucaagaacgagagcgaccccgagggcgcgcugugguga

SEQ ID NO: 8858 - RNA, 9879 nt, Artificial Sequence
  derived and/or modified CDS sequence (opt1) from DENV-1__KC692495__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgcgacgcuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgggagggcaagaucgucgggcuguacggcaacgggguggugaccaccagcggcacguacgucuccgccaucgcccaggccaaggcgagccaggaggggccccugcccgagaucgaggacgagguguucaagaagcgcaaccucaccaucauggaccugcacccgggcagcggcaagacccggcgcuaccugcccgccaucgugcgggaggccaucaagcgcaagcuccgcacccugauccuggcccccacgcgggucguggcguccgagauggccgaggcccucaaggggaugcccauccgcuaccagaccaccgccgucaagagcgagcacaccggccgggagaucgucgaccugaugugccacgccacguucaccaugcgccugcucuccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccucaagcccgucauccugaaggacgggcccgagcgggugauccuggccggcccgaugcccgucaccguggcgagcgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggaccuacuccgacccgcuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcggcacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcggacgaccugggcccucugcgaguccaucacccuggcgaccggcccgcugacgacccucugggaggggagccccggcaaguucuggaacaccaccaucgccgucuccauggccaacaucuuccgcggcagcuaccuggccggggccggccuggcguucucccucaugaagucccucgggggcgggcggcgcgggacgggcgcccagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgugagccggggcaccgcgaagcuccgcugguucgucgagcggaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccggacccugcgcgugcugaagaugguggagcccuggcuccggggcaaccaguucugcaucaagauccugaaccccuacaugccguccgucguggagacccuggagcagaugcagcgcaagcacgggggcaugcucgugcggaacccccugagccgcaacuccacgcacgagauguacugggucagcugcgggaccggcaacaucguguccgccgugaacaugaccagccggaugcugcucaaccgcuucaccauggcccaccgcaagcccacguacgagcgggacgucgaccugggcgcggggacccgccacguggccguggagcccgaggucgccaaccuggacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccuccugacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcuguggggguuccucucccggaacaagaagccccgcaucugcacccgggaggaguucacccgcaaggugcggagcaacgccgccaucggcgcggucuucguggacgagaaccaguggaacagcgccaaggaggccguggaggacgagcgcuucugggaccugguccaccgggagcgcgagcugcacaagcaggggaagugcgccacgugcguguacaacaugaugggcaagcgggagaagaagcucggggaguucggcaaggcgaagggcucccgcgccaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgccgacgacaccgcgggcugggacacccgcaucaccgaggacgaccugcagaacgaggccaagaucacggacaucauggagcccgagcacgcccuccuggccaccagcaucuucaagcugaccuaccagaacaaggucgugcgcgugcagcggcccgccaagaacgggaccgucauggacgugaucucccgccgggaccagcgcggcagcggccagguggggacguacggccucaacaccuucaccaacauggagguccagcugauccggcagauggaguccgaggggaucuuccugcccagcgagcucgagaccccgaaccuggcggagcgcgcccuggacuggcucgagaagcacggcgccgagcggcugaagcgcauggccaucuccggggacgacugcguggugaagcccaucgacgaccgguucgccacggcgcugaccgcccucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcccgcgugagccagggggccggcuggucccuccgggagaccgccugccugggcaagagcuacgcgcagauguggcagcugauguacuuccaccgccgggaccuccgccuggccgccaacgccaucugcuccgcgguccccguggacugggugcccgccagccggaccaccuggagcauccacgcccaccaccaguggaugacgaccgaggacaugcuguccgucuggaaccgcguguggaucgaggagaacccguggauggaggacaagacccacgugagcuccugggaggagguccccuaccucggcaagcgcgaggaccaguggugcggcagccugaucgggcugaccgcccgggccacgugggcgaccaacauccagguggccaucaaccaggugcgccggcucaucggcaacgagaacuaccuggacuacaugaccuccaugaagcgcuucaagaacgagagcgaccccgagggggcccugugguga

SEQ ID NO: 8859 - RNA, 9879 nt, Artificial Sequence
  derived and/or modified CDS sequence (opt1) from DENV-1__KC692496__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacguucaagaugcgcccgauguucgccguggggcuccuguuccggcgccugaccagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgucccccuggcgggcccgcuccuggccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgcgacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccuccccgagaucgaggacgagguguucaagaagcggaaccugaccaucauggaccugcacccgggcagcggcaagacccgccgguaccuccccgccaucgugcgcgaggccaucaagcgcaagcugcggacccugauccucgcccccacgcgcgucguggcguccgagauggccgaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgccggcccgaugcccgucaccguggcgagcgccgcccagcggcgcggccgcaucgggcggaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggucaugcuccacaacuccgagcagggcgggaaggccuaccggcacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgccgcggagaaccaccagcacgccaccaugcuggacguggaccugcacccggccagcgccuggacccucuacgccguggcgaccacggucaucacccccaugaugcgccacaccaucgagaacaccacggccaacaucucccugaccgccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacgcgcgaggcccagaagcggaccgcggccggcaucaugaagaaccccaccguggacggcaucgucgccaucgaccucgaccccgugguguacgacgccaaguucgagaagcagcuggggcagaucaugcugcucauccugugcaccagccagauccugcucaugcgcacgaccugggcccugugcgaguccaucacccuggcgaccggcccgcucacgacccugugggaggggagccccggcaaguucuggaacaccaccaucgccgucuccauggccaacaucuuccggggcagcuaccuggccggggccggccucgcguucucccugaugaagucccucgggggcgggcgccgggggacgggcgcccagggggagacccucggcgagaaguggaagcgccagcugaaccagcuguccaagagcgaguucaacaccuacaagcggagcgggaucauggagguggaccgcuccgaggccaaggagggccucaagcgcggggagaccacgaagcacgccgugagccgcggcaccgcgaagcugcggugguucgucgagcgcaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccgcacccugcgggugcucaagaugguggagcccuggcugcgcggcaaccaguucugcaucaagauccugaaccccuacaugccguccgucguggagacccucgagcagaugcagcggaagcacgggggcaugcuggugcgcaacccccugagccggaacuccacgcacgagauguacugggucagcugcgggaccggcaacaucguguccgccgugaacaugaccagccgcaugcuccugaaccgcuucaccauggcccaccggaagcccacguacgagcgcgacgucgaccugggcgcggggacccggcacguggccguggagcccgaggucgccaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcugcugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcucuggggguuccugucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggucgugcgggugcagcgccccgccaagaacgggaccgucauggacgugaucucccggcgcgaccagcggggcagcggccagguggggacguacggccugaacaccuucaccaacauggagguccagcugauccgccagauggaguccgaggggaucuuccuccccagcgagcuggagaccccgaaccuggcggagcgggcccucgacuggcuggagaagcacggcgccgagcgccugaagcggauggccaucuccggggacgacugcguggugaagcccaucgacgaccgcuucgccacggcgcucaccgcccugaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcgguccccguggacugggugcccgccagccgcaccaccuggagcauccacgcccaccaccaguggaugacgaccgaggacaugcucuccgucuggaaccgcguguggaucgaggagaacccguggauggaggacaagacccacgugagcuccugggaggagguccccuaccugggcaagcgggaggaccaguggugcggcagccugaucgggcucaccgcccgcgccacgugggcgaccaacauccagguggccaucaaccaggugcggcgccugaucggcaacgagaacuaccuggacuacaugaccuccaugaagcgguucaagaacgagagcgaccccgagggggcccucugguga

SEQ ID NO: 8860 - RNA, 9879 nt, Artificial Sequence
  derived and/or modified CDS sequence (opt1) from DENV-1__KC692497__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagcgcgggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggggugcuggagagcgagaugaucauccccaagaucuucggcgggccgaucucccagcacaacuaccggcccggcuacuucacccagaccgccgggcccuggcaccugggcaagcucgagcuggacuucgaccugugcgagggcacgaccguggucguggacgagcacugcgggaaccgcggcccgagccuccggaccaccacggugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggcauccugugcgugagcaucaugaucgaggaggugaugcggucccgcuggagccgcaagaugcucaugaccgggacgcuggccgucuuccugcuccugaucaugggccagcugaccuggaacgaccucauccggcugugcaucauggugggggccaacgcguccgaccgcaugggcaccggcaccacguaccuggcccucauggccaccuucaagaugcggccgauguucgccguggggcugcuguuccgccggcucaccagccgcgagguccugcugcucaccaucgggcugucccugguggccagcgucgagcuccccaacucccuggaggagcugggggacggccucgcgaugggcaucaugaugcugaagcugcucacggaguuccagccccaccagcuguggaccacccugcucagccugaccuucgugaagacgacccugucccucgacuacgccuggaagaccaccgccauggugcugagcaucgucucccuguucccccucugccugagcacgaccucccagaagaccaccuggcugccggugcuccuggggagcuucggcugcaagccccugaccauguuccucaucacggagaacaagaucugggggcggaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcaccaugaagaucaaggacgaggagcgcgacgacacccucaccauccugcugaaggccacgcuccuggccguguccggggucuaccccaugagcauccccgcgacccuguucgugugguacuucuggcagaagaagaagcagcgguccggcgugcucugggacacccccagcccgcccgaggucgagcgcgccgugcuggacgacggcaucuaccggauccugcagcgcgggcugcucggccggucccaggugggggucggcguguuccaggacgggguguuccacaccauguggcacgucacgcgcggcgccgugcugauguaccagggcaagcggcuggagcccagcugggccuccgugaagaaggaccucaucagcuacgggggcggguggcgcuuccagggcuccuggaacaccggggaggagguccaggugaucgccguggagcccggcaagaacccgaagaacguccagaccacccccggcacguucaagacccccgagggggaggugggcgcgaucgcccuggacuucaagcccgggaccagcggcuccccgaucgugaaccgggagggcaagaucgucgggcuguacggcaacgggguggugaccacgagcggcaccuacgucuccgccaucgcccaggccaaggcgagccaggaggggccccuccccgagaucgaggacgagguguucaagaagcgcaaccugaccaucauggaccugcacccgggcagcggcaagacccggcgcuaccuccccgccaucgugcgggaggccaucaagcgcaagcugcgcacgcugauccucgcccccacccgggucguggcguccgagauggccgaggcccugaaggggaugcccauccgcuaccagaccaccgccgucaagagcgagcacacgggccgggagaucgucgaccugaugugccacgccaccuucaccaugcgccuccuguccccggugcgggugcccaacuacaacaugaucaucauggacgaggcgcacuucaccgaccccgccagcaucgccgcccgcggguacaucuccacgcgggucggcaugggggaggccgcggccaucuucaugaccgccacgccgcccggcagcguggaggccuucccccaguccaacgccgugauccaggacgaggagcgcgacauccccgagcggagcuggaacuccggcuacgacuggaucaccgacuuccccgggaagacggucugguucgugcccagcaucaaguccggcaacgacaucgcgaacugccugcgcaagaacgggaagcgggugauccagcucagccgcaagaccuucgacaccgaguaccagaagaccaagaacaacgacugggacuacgucgugacgaccgacaucuccgagaugggcgccaacuuccgggccgaccgcgugaucgacccccggcgcugccugaagcccgucauccugaaggacgggcccgagcgggugauccucgccggcccgaugcccgucaccguggcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacgcccgagggcaucaucccggcgcuguucgagcccgagcgggagaaguccgccgccaucgacggggaguaccgccugcggggcgaggcccgcaagaccuucgucgagcucaugcggcgcggcgaccugcccguguggcugagcuacaagguggccuccgagggguuccaguacagcgaccggcgcuggugcuucgacggcgagcggaacaaccagguccucgaggagaacauggacguggagaucuggaccaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggucaugcuccacaacuccgagcagggcgggaaggccuaccgccacgccauggaggagcugcccgacacgaucgagacccugaugcuccuggcccugaucgcggugcucaccggcggggugacccuguucuuccugagcggcaagggccucgggaagacguccaucggccugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucgggcugcuguucaugauccucaccguggccgccaacgagaugggccugcuggagacgaccaagaaggaccucgggaucggcuacgucgccgcggagaaccaccagcacgccaccaugcuggacguggaccugcacccggccagcgccuggacccucuacgccguggcgacgaccgucaucacccccaugaugcggcacaccaucgagaacacgaccgccaacaucucccugaccgccaucgccaaccaggccgcgauccugaugggccucgacaagggguggcccaucagcaagauggacaucggcgugccccugcuggcccucgggugcuacucccaggugaacccgcugacccugacggccgccguccucaugcugguggcgcacuacgccaucaucggccccgggcugcaggccaaggccacccgcgaggcccagaagcgcaccgcggccggcaucaugaagaaccccaccguggacggcaucgucgccaucgaccucgaccccgugguguacgacgccaaguucgagaagcagcuggggcagaucaugcugcucauccugugcacgagccagauccugcucaugcggaccaccugggcccugugcgaguccaucacccuggcgacgggcccgcucaccacccugugggaggggagccccggcaaguucuggaacaccacgaucgccgucuccauggccaacaucuuccgcggcagcuaccuggccggggccggccucgcguucucccugaugaagucccucgggggcgggcggcgcgggaccggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagacgaccaagcacgccgugagccggggcaccgcgaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccacguacggguggaaccuggugaagcugcacagcggcaaggacgucuucuucaugccgcccgagaagugcgacacccuccugugcgacaucggggaguccagcccgaaccccaccaucgaggagggccggacccugcgcgugcucaagaugguggagcccuggcugcggggcaaccaguucugcaucaagauccugaaccccuacaugccguccgucguggagacgcucgagcagaugcagcgcaagcacgggggcaugcuggugcggaacccccugagccgcaacuccacccacgagauguacugggucagcugcgggaccggcaacaucguguccgccgugaacaugaccagccggaugcuccugaaccgcuucacgauggcccaccgcaagcccaccuacgagcgggacgucgaccugggcgcggggacccgccacguggccguggagcccgaggucgccaaccucgacgugaucggccagcggaucgagaacaucaagaacgagcacaaguccaccuggcacuacgacgaggacaacccguacaagacgugggccuaccacgggagcuacgaggucaagcccuccggcagcgccuccagcauggugaacggggugguccgccugcugaccaagcccugggacgugauccccauggugacccagaucgcgaugaccgacacgaccccguucggccagcagcgggucuucaaggagaagguggacacccgcacgccccgggccaagcgcggcacgacccagaucauggaggugaccgccaaguggcucuggggguuccugucccggaacaagaagccccgcaucugcacccgggaggaguucacgcgcaagguccggagcaacgccgccaucggcgcgguguucguggacgagaaccaguggaacagcgccaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgcgggcugggacacccgcaucacggaggacgaccuccagaacgaggccaagaucaccgacaucauggagcccgagcacgcccugcuggccaccagcaucuucaagcucaccuaccagaacaagguggugcgcguccagcggcccgccaagaacgggacggugauggacgugaucucccgccgggaccagcgcggcagcggccaggucgggaccuacggccugaacaccuucaccaacauggaggugcagcugauccggcagauggaguccgaggggaucuuccuccccagcgagcuggagacgccgaaccuggcggagcgcgcccucgacuggcuggagaagcacggcgccgagcggcugaagcgcauggccaucuccggggacgacugcguggucaagcccaucgacgaccgguucgccaccgcgcucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcucgugggccgggcccgcgucagccagggggccggcuggucccugcgggagaccgccugccugggcaagagcuacgcgcagauguggcagcucauguacuuccaccgccgggaccugcgccuggccgccaacgccaucugcuccgcggugcccguggacuggguccccgccagccggaccacguggagcauccacgcccaccaccaguggaugaccaccgaggacaugcucuccguguggaaccgcguguggaucgaggagaacccguggauggaggacaagacccacgucagcuccugggaggaggugcccuaccugggcaagcgcgaggaccaguggugcggcagccugaucgggcucacggcccgggccaccugggcgaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8861 - RNA, 9879 nt, Artificial Sequence
  derived and/or modified CDS sequence (opt1) from DENV-1__KC692498__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagcgcgggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggggugcuggagagcgagaugaucauccccaagaucuucggcgggccgaucucccagcacaacuaccggcccggcuacuucacccagaccgccgggcccuggcaccugggcaagcucgagcuggacuucgaccugugcgagggcacgaccguggucguggacgagcacugcgggaaccgcggcccgagccuccggaccaccacggugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggcauccugugcgugagcaucaugaucgaggaggugaugcggucccgcuggagccgcaagaugcucaugaccgggacgcuggccgucuuccugcuccugaucaugggccagcugaccuggaacgaccucauccggcugugcaucauggugggggccaacgcguccgaccgcaugggcaccggcaccacguaccuggcccucauggccaccuucaagaugcggccgauguucgccguggggcugcuguuccgccggcucaccagccgcgagguccugcugcucaccaucggccugucccugguggccagcgucgagcuccccaacucccuggaggagcugggggacggccucgcgaugggcaucaugaugcugaagcugcucacggaguuccagccccaccagcuguggaccacccugcucagccugaccuucgugaagacgacccugucccucgacuacgccuggaagaccaccgccauggugcugagcaucgucucccuguucccccucugccugagcacgaccucccagaagaccaccuggcugccggugcuccuggggagcuucggcugcaagccccugaccauguuccucaucacggagaacaagaucugggggcggaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcaccaugaagaucaaggacgaggagcgcgacgacacccucaccauccugcugaaggccacgcuccuggccguguccggggucuaccccaugagcauccccgcgacccuguucgugugguacuucuggcagaagaagaagcagcgguccggcgugcucugggacacccccagcccgcccgaggucgagcgcgccgugcuggacgacggcaucuaccggauccugcagcgcgggcugcucggccggucccaggugggggucggcguguuccaggacgggguguuccacaccauguggcacgucacgcgcggcgccgugcugauguaccagggcaagcggcuggagcccagcugggccuccgugaagaaggaccucaucagcuacgggggcggguggcgcuuccagggcuccuggaacaccggggaggagguccaggugaucgccguggagcccggcaagaacccgaagaacguccagaccacccccggcacguucaagacccccgagggggaggugggcgcgaucgcccuggacuucaagcccgggaccagcggcuccccgaucgugaaccgggagggcaagaucgucgggcuguacggcaacgggguggugaccacgagcggcaccuacgucuccgccaucgcccaggccaaggcgagccaggaggggccccuccccgagaucgaggacgagguguucaagaagcgcaaccugaccaucauggaccugcacccgggcagcggcaagacccggcgcuaccuccccgccaucgugcgggaggccaucaagcgcaagcugcgcacgcugauccucgcccccacccgggucguggcguccgagauggccgaggcccugaaggggaugcccauccgcuaccagaccaccgccgucaagagcgagcacacgggccgggagaucgucgaccugaugugccacgccaccuucaccaugcgccuccuguccccggugcgggugcccaacuacaacaugaucaucauggacgaggcgcacuucaccgaccccgccagcaucgccgcccgcggguacaucuccacgcgggucggcaugggggaggccgcggccaucuucaugaccgccacgccgcccggcagcguggaggccuucccccaguccaacgccgugauccaggacgaggagcgcgacauccccgagcggagcuggaacuccggcuacgacuggaucaccgacuucagcgggaagacggucugguucgugcccuccaucaagagcggcaacgacaucgcgaacugccugcgcaagaacgggaagcgggugauccagcucucccgcaagaccuucgacaccgaguaccagaagaccaagaacaacgacugggacuacgucgugacgaccgacaucagcgagaugggcgccaacuuccgggccgaccgcgugaucgacccccggcgcugccugaagcccgucauccugaaggacgggcccgagcgggugauccucgccggccccaugccggucaccguggcguccgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacgcccgagggcaucauccccgcgcuguucgagccggagcgggagaaguccgccgccaucgacggggaguaccgccugcggggcgaggcccgcaagaccuucgucgagcucaugcggcgcggcgaccugcccguguggcuguccuacaagguggccagcgagggguuccaguacuccgaccggcgcuggugcuucgacggcgagcggaacaaccagguccucgaggagaacauggacguggagaucuggaccaaggagggggagcgcaagaagcugcggccccgcuggcuggacgcgcggaccuacagcgacccccucgcccugcgcgaguucaaggaguucgccgccggccggcgcagcguguccggcgaccugauccucgagaucgggaagcugccgcagcaccugacccuccgggcccagaacgcgcuggacaaccuggucaugcuccacaacagcgagcagggcgggaaggccuaccgccacgccauggaggagcugcccgacacgaucgagacccugaugcuccuggcccugaucgcggugcucaccggcggggugacccuguucuuccuguccggcaagggccucgggaagacgagcaucggccugcugugcgucaccgccuccagcgcccuccuguggauggccuccguggagccccacuggaucgccgcgagcaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagacgaccaagaaggaccucgggaucggcuacgucgccgcggagaaccaccagcacgccaccaugcuggacguggaccugcaccccgccuccgccuggacccucuacgccguggcgacgaccgucaucaccccgaugaugcggcacaccaucgagaacacgaccgccaacaucagccugaccgccaucgccaaccaggccgcgauccugaugggccucgacaagggguggcccaucuccaagauggacaucggcgugccccugcuggcccucgggugcuacagccaggugaacccccugacccugacggccgccguccucaugcugguggcgcacuacgccaucaucggcccggggcugcaggccaaggccacccgcgaggcccagaagcgcaccgcggccggcaucaugaagaaccccaccguggacggcaucgucgccaucgaccucgaccccgugguguacgacgccaaguucgagaagcagcuggggcagaucaugcugcucauccugugcacgucccagauccugcucaugcggaccaccugggcccugugcgagagcaucacccuggcgacgggcccccucaccacccugugggagggguccccgggcaaguucuggaacaccacgaucgccgucagcauggccaacaucuuccgcggcuccuaccuggccggggccggccucgcguucagccugaugaagucccucgggggcgggcggcgcgggaccggcgcccagggggagacccucggcgagaaguggaagcggcagcugaaccagcugagcaagagcgaguucaacaccuacaagcgcuccgggaucauggagguggaccggagcgaggccaaggagggccucaagcgcggggagacgaccaagcacgccgugucccggggcaccgcgaagcugcgcugguucgucgagcggaaccuggugaagcccgagggcaaggugaucgaccuggggugcggccgcgggggcuggagcuacuacugcgccgggcucaagaaggucaccgaggugaagggcuacaccaagggcgggcccggccacgaggagcccaucccgauggccacguacggguggaaccuggugaagcugcacuccggcaaggacgucuucuucaugccgcccgagaagugcgacacccuccugugcgacaucggggagagcucccccaacccgaccaucgaggagggccggacccugcgcgugcucaagaugguggagcccuggcugcggggcaaccaguucugcaucaagauccugaaccccuacaugcccagcgucguggagacgcucgagcagaugcagcgcaagcacgggggcaugcuggugcggaacccgcugucccgcaacagcacccacgagauguacugggucuccugcgggaccggcaacaucgugagcgccgugaacaugaccucccggaugcuccugaaccgcuucacgauggcccaccgcaagcccaccuacgagcgggacgucgaccugggcgcggggacccgccacguggccguggagcccgaggucgccaaccucgacgugaucggccagcggaucgagaacaucaagaacgagcacaagagcaccuggcacuacgacgaggacaaccccuacaagacgugggccuaccacggguccuacgaggucaagccgagcggcuccgccagcuccauggugaacggggugguccgccugcugaccaagcccugggacgugauccccauggugacccagaucgcgaugaccgacacgacccccuucggccagcagcgggucuucaaggagaagguggacacccgcaccccgcgggccaagcgcggcacgacccagaucauggaggugaccgccaaguggcucuggggguuccugagccggaacaagaagccccgcaucugcacccgggaggaguucacgcgcaagguccggagcaacgccgccaucggcgcgguguucguggacgagaaccaguggaacuccgccaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggcgaagggcagccgcgccaucugguacauguggcugggggcccgguuccucgaguucgaggcccugggcuucaugaacgaggaccacugguucucccgcgagaacagccuguccggggucgagggcgaggggcuccacaagcugggcuacauccugcgggacaucagcaagauccccggcgggaacauguacgccgacgacaccgcgggcugggacacccgcaucacggaggacgaccuccagaacgaggccaagaucaccgacaucauggagccggagcacgcccugcuggccaccuccaucuucaagcucaccuaccagaacaagguggugcgcguccagcggcccgccaagaacgggacggugauggacgugaucagccgccgggaccagcgcggcuccggccaggucgggaccuacggccugaacaccuucaccaacauggaggugcagcugauccggcagauggagagcgaggggaucuuccuccccuccgagcuggagacgcccaaccuggcggagcgcgcccucgacuggcuggagaagcacggcgccgagcggcugaagcgcauggccaucagcggggacgacugcguggucaagccgaucgacgaccgguucgccaccgcgcucaccgcccugaacgacaugggcaaggugcgcaaggacaucccccagugggagcccuccaagggcuggaacgacuggcagcagguccccuucugcagccaccacuuccaccagcugaucaugaaggacgggcgggagaucgucgugccgugccgcaaccaggacgagcucgugggccgggcccgcgucucccagggggccggcuggagccugcgggagaccgccugccuggggaaguccuacgcgcagauguggcagcucauguacuuccaccgccgggaccugcgccuggccgccaacgccaucugcagcgcggugcccguggacuggguccccgccagccggaccacgugguccauccacgcccaccaccaguggaugaccaccgaggacaugcucagcguguggaaccgcguguggaucgaggagaaccccuggauggaggacaagacccacgucuccagcugggaggaggugccguaccugggcaagcgcgaggaccaguggugcggcucccugaucgggcucacggcccgggccaccugggcgaccaacauccagguggccaucaaccagguccgccggcugaucggcaacgagaacuaccuggacuacaugaccagcaugaagcgcuucaagaacgaguccgaccccgagggggcccucugguga

SEQ ID NO: 8862 - RNA, 9879 nt, Artificial Sequence
  derived and/or modified CDS sequence (opt1) from DENV-1__KC692499__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcggguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgucaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcgcgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggaguacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuucggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagccccaccagcucuggacgacccugcugagccucaccuucgugaagaccacgcugucccuggacuacgcguggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccuggccggcccgcucaucgcgggcgggaugcugaucgccugcuacgugaucagcggcuccagcgccgaccugucccucgagaaggccgccgaggucagcugggagcaggaggcggagcacuccggggccagccacaacauccugguggaggugcaggacgacggcacgaugaagaucaaggacgaggagcgcgacgacacccugaccauccuccugaaggccacccugcucgccgucuccgggguguaccccaugagcauccccgccacgcuguucgugugguacuucuggcagaagaagaagcagcgguccggcguccugugggacacccccagcccgcccgagguggagcgcgcggugcucgacgacggcaucuaccggauccugcagcgcgggcugcugggccggucccaggucggggugggcguguuccaggacggggucuuccacaccauguggcacgugacccgcggcgccgugcucauguaccagggcaagcggcuggagcccagcugggccuccgucaagaaggaccugaucagcuacgggggcggguggcgcuuccagggcuccuggaacacgggggaggagguccaggugaucgccgucgagcccggcaagaacccgaagaacgugcagaccacccccggcaccuucaagacgcccgagggggaggugggcgccaucgcgcucgacuucaagcccgggaccagcggcuccccgaucgucaaccgggagggcaagaucguggggcuguacggcaacgggguggucaccaccagcggcacguacguguccgccaucgcccaggccaaggccagccaggaggggccccugcccgagaucgaggacgagguguucaagaagcgcaaccucaccaucauggaccugcacccgggcagcggcaagacccggcgcuaccugcccgcgaucguccgggaggccaucaagcgcaagcuccgcacccugauccuggcccccacgcgggugguggccuccgagauggcggaggcccucaaggggaugcccauccgcuaccagaccaccgccgucaagagcgagcacaccggccgggagaucguggaccugaugugccacgccacguucaccaugcgccugcucuccccggugcggguccccaacuacaacaugaucaucauggacgaggcccacuucaccgaccccgcgagcaucgccgcccgcggguacaucuccacccgggugggcaugggggaggccgccgcgaucuucaugacggccacgccgcccggcagcguggaggccuucccccaguccaacgccgucauccaggacgaggagcgcgacauccccgagcggagcuggaacuccggcuacgacuggaucgccgacuuccccgggaagaccgugugguucgugcccagcaucaaguccggcaacgacaucgcgaacugccugcgcaagaacgggaagcgggucauccagcugagccgcaagaccuucgacacggaguaccagaagaccaagaacaacgacugggacuacguggugaccaccgacaucuccgagaugggcgccaacuuccgggccgaccgcgucaucgacccccggcgcugccucaagcccgugauccugaaggacgggcccgagcgggucauccuggccggcccgaugcccgugacgguggcgagcgccgcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagaccuucguggagcugaugcggcgcggcgaccuccccguguggcugagcuacaaggucgccuccgagggguuccaguacagcgaccggcgcuggugcuucgacggcgagcggaacaaccaggugcuggaggagaacauggacguggagaucuggacgaaggagggggagcgcaagaagcuccggccccgcuggcuggacgcgcggaccuacuccgacccgcuggcccuccgcgaguucaaggaguucgccgccggccggcgcagcgucagcggcgaccugauccuggagaucgggaagcucccccagcaccugacccugcgggcccagaacgcgcucgacaaccuggugaugcugcacaacuccgagcagggcgggaaggccuaccgccacgccauggaggagcuccccgacaccaucgagacccugaugcugcucgcccugaucgcggugcugacgggcggggucacccucuucuuccugagcggcaagggccuggggaagaccuccaucggccuccugugcgugaccgccagcuccgcccugcucuggauggccagcguggagccccacuggaucgccgcguccaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagaccaccaagaaggaccuggggaucggcuacguggccgcggagaaccaccagcacgccacgaugcucgacguggaccugcacccggccagcgccuggacccuguacgccgucgcgaccaccgugaucacgcccaugaugcggcacaccaucgagaacaccaccgccaacaucucccucacggccaucgccaaccaggccgcgauccugaugggccuggacaagggguggcccaucagcaagauggacaucggcgugccccuccuggcccuggggugcuacucccaggucaacccgcucacccugaccgccgccgugcugaugcucguggcgcacuacgccaucaucggccccgggcugcaggccaaggccacccgcgaggcccagaagcgcacggcggccggcaucaugaagaaccccaccgucgacggcaucguggccaucgaccuggaccccguggucuacgacgccaaguucgagaagcagcucgggcagaucaugcugcugauccucugcaccagccagauccugcugaugcggaccacgugggcccucugcgaguccaucacccuggcgaccggcccgcugaccacgcucugggaggggagccccggcaaguucuggaacaccaccaucgccguguccauggccaacaucuuccgcggcagcuaccuggccggggccggccuggcguucucccucaugaagucccucgggggcgggcggcgcgggaccggcgcccagggggagacgcugggcgagaaguggaagcggcagcucaaccagcuguccaagagcgaguucaacaccuacaagcgcagcgggaucauggagguggaccgguccgaggccaaggagggccugaagcgcggggagaccaccaagcacgccgucagccggggcacggcgaagcuccgcugguucguggagcggaaccuggugaagcccgagggcaaggucaucgaccuggggugcggccgcgggggcugguccuacuacugcgccgggcugaagaaggugaccgaggugaagggcuacaccaagggcgggcccggccacgaggagccgauccccauggccaccuacggguggaaccucgucaagcugcacagcggcaaggacguguucuucaugccgcccgagaagugcgacacccugcucugcgacaucggggaguccagcccgaaccccacgaucgaggagggccggacccugcgcgugcugaagauggucgagcccuggcuccggggcaaccaguucugcaucaagauccugaaccccuacaugccguccgugguggagacccuggagcagaugcagcgcaagcacgggggcaugcucguccggaacccccugagccgcaacuccacccacgagauguacugggugagcugcgggacgggcaacaucguguccgccgucaacaugaccagccggaugcugcucaaccgcuucaccauggcccaccgcaagcccaccuacgagcgggacguggaccugggcgcggggacgcgccacguggccgucgagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccuccugaccaagcccugggacgugauccccauggugacgcagaucgcgaugaccgacaccaccccguucggccagcagcgggucuucaaggagaagguggacacgcgcacgccccgggccaagcgcggcaccacccagaucauggaggugacggccaaguggcuguggggguuccucucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggcgaagggcucccgcgccaucugguacauguggcugggggcccgguuccuggaguucgaggcccucggcuucaugaacgaggaccacugguucagccgcgagaacucccugagcggggucgagggcgaggggcugcacaagcucggcuacauccugcgggacaucuccaagaucccgggcgggaacauguacgccgacgacacggcgggcugggacacccgcaucaccgaggacgaccugcagaacgaggccaagaucaccgacaucauggagcccgagcacgcccuccuggccacgagcaucuucaagcugaccuaccagaacaagguggugcgcguccagcggcccgccaagaacgggaccgugauggacgugaucucccgccgggaccagcgcggcagcggccaggucgggaccuacggccucaacacguucaccaacauggaggugcagcugauccggcagauggaguccgaggggaucuuccugcccagcgagcucgagaccccgaaccuggcggagcgcgcccuggacuggcucgagaagcacggcgccgagcggcugaagcgcauggccaucuccggggacgacugcguggucaagcccaucgacgaccgguucgccaccgcgcugacggcccucaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcuggugggccgggcccgcgucagccagggggccggcuggucccuccgggagaccgccugccugggcaagagcuacgcgcagauguggcagcugauguacuuccaccgccgggaccuccgccuggccgccaacgccaucugcuccgcggugcccguggacuggguccccgccagccggaccaccuggagcauccacgcccaccaccaguggaugaccacggaggacaugcuguccguguggaaccgcguguggaucgaggagaacccguggauggaggacaagacccacgucagcuccugggaggaggugcccuaccucggcaagcgcgaggaccaguggugcggcagccugaucgggcugaccgcccgggccaccugggcgacgaacauccagguggccaucaaccagguccgccggcucaucggcaacgagaacuaccuggacuacaugaccuccaugaagcgcuucaagaacgagagcgaccccgagggggcccugugguga

SEQ ID NO: 8863 - RNA, 9879 nt, Artificial Sequence
  derived and/or modified CDS sequence (opt1) from DENV-1__KC692500__SS-prME
agcgugaccaugcugcucaugcugcugcccaccgcgcucgccuuccaccugaccacccgcggcggggagccccacaugaucgugagcaagcaggagcggggcaagagccuccucuucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccacccgggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccgcaccggccuggacuucaacgagaugguccugcucacgaugaaggggaaguccuggcuggugcacaagcagugguuccuggaccucccgcugcccuggaccuccggcgccagcaccagccaggagaccuggaaccggcaggaccugcucgugacguucaagaccgcccacgcgaagaagcaggaggucguggugcugggcucccaggagggggccaugcacaccgcccugaccggcgccacggagauccagaccagcgggaccaccacgaucuucgccggccaccucaagugccgccugaagauggacaagcugacccucaaggggauguccuacgucaugugcaccggcagcuucaagcuggagaaggagguggcggagacccagcacggcacggugcugguccaggugaaguacgaggggaccgacgcccccugcaagauccccuucuccacccaggacgagaagggcgugacccagaacgggcggcugaucacggccaacccgaucgucaccgacaaggagaagcccgugaacaucgagaccgagccgcccuucggcgagagcuacaucguggucggcgccggggagaaggcgcucaagcuguccugguucaagcgcggcagcuccaucgggaagauguucgaggccaccgcccggggcgcccgccgcauggccauccugggggacacggcgugggacuucggcagcaucggcgggguguucaccuccgugggcaagcucguccaccagguguucgggaccgccuacggcgugcuguucagcggggucuccuggaccaugaagaucggcaucggcauccugcucacguggcuggggcugaacagccgguccaccagccucuccaugaccugcaucgccgugggcauggugacccuguaccugggggucauggugcaggccgacagcggcugcgugaucaacuggaaggggcgcgagcucaagugcggcuccggcaucuucgucacgaacgaggugcacaccuggaccgagcaguacaaguuccaggccgacagcccgaagcggcugagcgcggccaucgggaaggccugggaggagggcgugugcgggauccgcuccgccacccggcuggagaacaucauguggaagcagaucagcaacgagcucaaccacauccugcuggagaacgacaugaaguucaccgucguggugggcgacgccaacgggauccucgcgcagggcaagaagaugauccgcccccagcccauggagcacaaguacuccuggaaguccuggggcaaggccaagaucaucggggccgacauccagaacacgaccuucaucaucgacggccccgacaccccggagugccccgacgggcagcgggccuggaacaucugggaggucgaggacuacggcuucggcguguucaccacgaacaucuggcugaagcugcgcgacuccuacacccagaugugcgaccaccggcucaugagcgcggccaucaaggacuccaaggccgugcacgccgacaugggguacuggaucgagagcgagaagaacgagaccuggaagcuggcccgcgcguccuucaucgaggucaagaccugcacguggcccaagagccacacccugugguccaacggcgugcucgagagcgagaugaucauccccaagaucuucgggggcccgaucucccagcacaacuaccggcccggguacuucacccagaccgccggccccuggcaccugggcaagcuggagcucgacuucgaccugugcgaggggacgaccguggucguggacgagcacugcggcaaccgcgggccgagccugcggaccaccacggugaccggcaagaucauccacgaguggugcugccgcuccugcacccugccgccccugcgguuccgcggggaggacggcugcugguacggcauggagauccggcccgucaaggagaaggaggagaaccuggugcgcagcaugguguccgccgggagcggcgaggucgacagcuucucccucgggauccugugcgugagcaucaugaucgaggaggugaugcggucccgcuggagccgcaagaugcugaugaccggcacgcucgccgucuuccugcugcucaucauggggcagcugaccuggaacgaccugauccggcucugcaucauggugggcgccaacgcguccgaccgcaugggcauggggaccaccuaccuggcccugauggccacguucaagaugcggccgauguucgccgugggccuccuguuccgccggcugaccagccgcgagguccuccugcugaccaucgggcucucccugguggccagcgucgagcugcccaacucccucgaggagcugggcgacggccuggcgauggggaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucggcagcuucgggugcaagccccugaccauguuccugaucaccgagaacaagaucuggggccggaaguccuggccccucaacgaggggaucauggccaucggcaucgugagcauccugcuguccagccuccugaagaacgacgucccccuggcgggcccgcucaucgccgggggcaugcugaucgccugcuacgugaucagcggguccagcgccgaccugucccucgagaaggccgcggaggugagcugggagcaggaggccgagcacuccggcgccagccacaacauccuggucgaggugcaggacgacgggacgaugaagaucaaggacgaggagcgcgacgacacccugaccauccuccugaaggccacccugcucgccguguccggcgucuaccccaugagcauccccgcgacgcuguucgugugguacuucuggcagaagaagaagcagcgguccggcgugcugugggacacccccagcccgcccgaggucgagcgcgccgugcucgacgacgggaucuaccggauccugcagcgcggccugcuggggcggucccaggugggcgucgggguguuccaggacggcguguuccacaccauguggcacgucacccgcggcgccgugcucauguaccaggggaagcggcuggagcccagcugggccuccgugaagaaggaccugaucagcuacggcgggggcuggcgcuucaagggguccuggaacacgggcgaggagguccaggugaucgccguggagcccggcaagaacccgaagaacguccagaccacccccgggaccuucaagacgcccgagggcgaggugggggcgaucgcccucgacuucaagcccggcaccagcggcuccccgaucgugaaccgggaggggaagaucgucggccuguacgggaacggcguggugaccaccagcgggacguacgucuccgccaucgcccaggccaaggcgagccaggagggcccccugcccgagaucgaggacgagguguucaagaagcgcaaccucaccaucauggaccugcacccgggcagcgggaagacccggcgcuaccugcccgccaucgugcgggaggccaucaagcgcaagcuccgcacccugauccuggcccccacgcgggucguggcguccgagauggccgaggcccucaagggcaugcccauccgcuaccagaccaccgccgucaagagcgagcacaccgggcgggagaucgucgaccugaugugccacgccacguucaccaugcgccugcucuccccggugcgggugcccaacuacaacaugaucaucauggacgaggcgcacuucaccgaccccgccagcaucgccgcccgcggcuacaucuccacccgggucgggaugggcgaggccgcggccaucuucaugacggccacgccgcccggcagcguggaggccuucccccaguccaacgccgugauccaggacgaggagcgcgacauccccgagcggagcuggaacuccggguacgacuggaucaccgacuuccccggcaagaccgucugguucgugcccagcaucaaguccgggaacgacaucgcgaacugccugcgcaagaacggcaagcgggugauccagcugagccgcaagacguucgacaccgaguaccagaagaccaagaacaacgacugggacuacgucgugaccacggacaucuccgagaugggggccaacuuccgggccgaccgcgugaucgacccccggcgcugccucaagcccgucauccugaaggacggccccgagcgggugauccuggccggcccgaugcccgucaccguggcgagcgccgcccagcgccgggggcgcaucggccgcaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugcggggcgaggcccgcaagacguucgucgagcugaugcggcgcggggaccuccccguguggcugagcuacaagguggccuccgagggcuuccaguacagcgaccggcgcuggugcuucgacggggagcggaacaaccagguccuggaggagaacauggacguggagaucuggaccaaggagggcgagcgcaagaagcuccggccccgcuggcuggacgcgcggaccuacuccgacccgcuggcccuccgcgaguucaaggaguucgccgccggccggcgcagcgugagcggggaccugauccuggagaucggcaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccgggggcgugacccucuucuuccugagcggcaaggggcugggcaagaccuccaucgggcuccugugcgucacggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucggccuccuguucaugauccugaccguggccgccaacgagauggggcuccuggagaccacgaagaaggaccugggcaucggcuacgucgccgcggagaaccaccagcacgccaccaugcucgacguggaccugcacccggccagcgccuggacccuguacgccguggcgaccacggucaucacccccaugaugcggcacaccaucgagaacaccacggccaacaucucccucaccgccaucgccaaccaggccgcgauccugauggggcuggacaagggcuggcccaucagcaagauggacaucggggugccccuccuggcccugggcugcuacucccaggugaacccgcucacccugaccgccgccguccugaugcucguggcgcacuacgccaucaucgggcccggccugcaggccaaggccacgcgcgaggcccagaagcgcaccgcggccggcaucaugaagaaccccaccguggacgggaucgucgccaucgaccuggaccccgugguguacgacgccaaguucgagaagcagcucggccagaucaugcugcugauccucugcaccagccagauccugcugaugcggacgaccugggcccucugcgaguccaucacccuggcgaccgggccgcugacgacccucugggagggcagccccggcaaguucuggaacaccaccaucgccgucuccauggccaacaucuuccgcgggagcuaccuggccggcgccgggcuggcguucucccucaugaagucccugggcgggggccggcgcggcacgggggcccagggcgagacccugggggagaaguggaagcggcagcucaaccagcuguccaagagcgaguucaacaccuacaagcgcagcggcaucauggagguggaccgguccgaggccaaggaggggcugaagcgcggcgagaccacgaagcacgccgugagccggggcaccgcgaagcuccgcugguucgucgagcggaaccuggugaagcccgaggggaaggugaucgaccugggcugcgggcgcggcgggugguccuacuacugcgccggccugaagaaggucaccgaggugaagggcuacaccaagggcgggcccgggcacgaggagccgauccccauggccaccuacggcuggaaccucgugaagcugcacagcgggaaggacgucuucuucaugccgcccgagaagugcgacacgcugcucugcgacaucggcgaguccagcccgaaccccaccaucgaggagggccggacccugcgcgugcugaagaugguggagcccuggcuccgggggaaccaguucugcaucaagauccugaaccccuacaugccguccgucguggagacccuggagcagaugcagcgcaagcacggcgggaugcucgugcggaacccccugagccgcaacuccacgcacgagauguacugggucagcugcggcaccggcaacaucguguccgccgugaacaugaccagccggaugcugcucaaccgcuucaccauggcccaccgcaagcccacguacgagcgggacgucgaccugggggcgggcacccgccacguggccguggagcccgaggucgccaaccuggacaucaucgggcagcggaucgagaacaucaagaacgagcacaaguccaccuggcacuacgacgaggacaacccguacaagaccugggccuaccacggcagcuacgaggugaagcccuccgggagcgccuccagcauggucaacggcguggugcgccuccugacgaagcccugggacgucauccccauggugacccagaucgcgaugaccgacaccacgccguucggccagcagcggguguucaaggagaaggucgacacccgcacgccccgggccaagcgcgggaccacgcagaucauggaggugaccgccaaguggcuguggggcuuccucucccggaacaagaagccccgcaucugcacccgggaggaguucacccgcaaggugcggagcaacgccgccaucggggcggucuucguggacgagaaccaguggaacagcgccaaggaggccguggaggacgagcgcuucugggaccugguccaccgggagcgcgagcugcacaagcagggcaagugcgccacgugcguguacaacaugauggggaagcgggagaagaagcucggcgaguucggcaaggcgaaggggucccgcgccaucugguacauguggcugggcgcccgguuccuggaguucgaggcccucggguucaugaacgaggaccacugguucagccgcgagaacucccugagcggcguggagggggagggccugcacaagcucggcuacauccugcgggacaucuccaagauccccggcgggaacauguacgccgacgacaccgcggggugggacacccgcaucaccgaggacgaccugcagaacgaggccaagaucacggacaucauggagcccgagcacgcccuccuggccaccagcaucuucaagcugaccuaccagaacaaggucgugcgcgugcagcggcccgccaagaacgggaccgucauggacgugaucucccgccgggaccagcgcggcagcggccaggugggcacguacgggcucaacaccuucaccaacauggagguccagcugauccggcagauggaguccgagggcaucuuccugcccagcgagcucgagaccccgaaccuggcggagcgcgcccuggacuggcucgagaagcacggggccgagcggcugaagcgcauggccaucuccggcgacgacugcguggugaagcccaucgacgaccgguucgccacggcgcugaccgcccucaacgacaugggcaagguccgcaaggacaucccccagugggagcccagcaagggguggaacgacuggcagcaggucccguucugcucccaccacuuccaccagcugaucaugaaggacggccgggagaucgugguccccugccgcaaccaggacgagcugguggggcgggcccgcgugagccagggcgccggguggucccuccgggagaccgccugccugggcaagagcuacgcgcagauguggcagcugauguacuuccaccgccgggaccuccgccuggccgccaacgccaucugcuccgcgguccccguggacugggugcccgccagccggaccaccuggagcauccacgcccaccaccaguggaugacgaccgaggacaugcuguccgucuggaaccgcguguggaucgaggagaacccguggauggaggacaagacccacgugagcuccugggaggagguccccuaccucggcaagcgcgaggaccaguggugcgggagccugaucggccugaccgcccgggccacgugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8864 - RNA, 9879 nt, Artificial Sequence
  derived and/or modified CDS sequence (opt1) from DENV-1__KC692501__SS-prME
agcgugaccaugcugcucaugcugcugcccaccgcccucgccuuccaccugaccacccggggcggggagccccacaugaucgugagcaagcaggagcggggcaagagccuccucuucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgcgacgcuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgggaggagaagaucgucggccuguacgggaacggcguggugaccaccagcgggacguacgucuccgccaucgcccaggccaaggcgagccaggagggcccccugcccgagaucgaggacgagguguucaagaagcgcaaccucaccaucauggaccugcacccggggagcggcaagacccggcgcuaccugcccgccaucgugcgggaggccaucaagcgcaagcuccgcacccugauccuggcccccacgcgggucguggcguccgagauggccgaggcccucaagggcaugcccauccgcuaccagaccaccgccgucaagagcgagcacaccgggcgggagaucgucgaccugaugugccacgccacguucaccaugcgccugcucuccccggugcgggugcccaacuacaacaugaucaucauggacgaggcgcacuucaccgaccccgccagcaucgccgcccgcggcuacaucuccacccgggucgggaugggcgaggccgcggccaucuucaugacggccacgccgcccgggagcguggaggccuucccccaguccaacgccgugauccaggacgaggagcgcgacauccccgagcggagcuggaacuccggcuacgacuggaucaccgacuuccccggcaagaccgucugguucgugcccagcaucaaguccgggaacgacaucgcgaacugccugcgcaagaacggcaagcgggugauccagcugagccgcaagacguucgacaccgaguaccagaagaccaagaacaacgacugggacuacgucgugaccacggacaucuccgagaugggggccaacuuccgggccgaccgcgugaucgacccccggcgcugccucaagcccgucauccugaaggacggccccgagcgggugauccuggccgggccgaugcccgucaccguggcgagcgccgcccagcgccggggccgcaucggccgcaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugcgcggggaggcccgcaagacguucgucgagcugaugcggcgcggcgaccuccccguguggcugagcuacaagguggccuccgagggcuuccaguacagcgaccggcgcuggugcuucgacggggagcggaacaaccagguccuggaggagaacauggacguggagaucuggaccaaggagggcgagcgcaagaagcuccggccccgcuggcuggacgcgcggaccuacuccgacccgcuggcccuccgcgaguucaaggaguucgccgccgggcggcgcagcgugagcggcgaccugauccuggagaucggcaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccgggggcgugacccucuucuuccugagcgggaagggccugggcaagaccuccaucgggcuccugugcgucacggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucggccuccuguucaugauccugaccguggccgccaacgagauggggcuccuggagaccacgaagaaggaccugggcaucggguacgucgccgcggagaaccaccagcacgccaccaugcucgacguggaccugcacccggccagcgccuggacccuguacgccguggcgaccacggucaucacccccaugaugcggcacaccaucgagaacaccacggccaacaucucccucaccgccaucgccaaccaggccgcgauccugaugggccuggacaagggcuggcccaucagcaagauggacaucggggugccccuccuggcccugggcugcuacucccaggugaacccgcucacccugaccgccgccguccugaugcucguggcgcacuacgccaucaucgggcccggccugcaggccaaggccacgcgcgaggcccagaagcgcaccgcggccgggaucaugaagaaccccaccguggacggcaucgucgccaucgaccuggaccccgugguguacgacgccaaguucgagaagcagcucggccagaucaugcugcugauccucugcaccagccagauccugcugaugcggacgaccugggcccucugcgaguccaucacccuggcgaccgggccgcugacgacccucugggagggcagccccgggaaguucuggaacaccaccaucgccgucuccauggccaacaucuuccgcggcagcuaccuggccggcgccgggcuggcguucucccucaugaagucccugggcgggggccggcgcgggacgggcgcccagggcgagacccugggggagaaguggaagcggcagcucaaccagcuguccaagagcgaguucaacaccuacaagcgcagcggcaucauggagguggaccgguccgaggccaaggaggggcugaagcgcggcgagaccacgaagcacgccgugagccgggggaccgcgaagcuccgcugguucgucgagcggaaccuggugaagcccgagggcaaggugaucgaccugggcugcgggcgcggcgggugguccuacuacugcgccggccugaagaaggucaccgaggugaagggguacaccaagggcggccccgggcacgaggagccgauccccauggccaccuacggcuggaaccucgugaagcugcacagcgggaaggacgucuucuucaugccgcccgagaagugcgacacgcugcucugcgacaucggcgaguccagcccgaaccccaccaucgaggaggggcggacccugcgcgugcugaagaugguggagcccuggcuccggggcaaccaguucugcaucaagauccugaaccccuacaugccguccgucguggagacccuggagcagaugcagcgcaagcacggcgggaugcucgugcggaacccccugagccgcaacuccacgcacgagauguacugggucagcugcggcaccgggaacaucguguccgccgugaacaugaccagccggaugcugcucaaccgcuucaccauggcccaccgcaagcccacguacgagcgggacgucgaccugggcgcgggcacccgccacguggccguggagcccgaggucgccaaccuggacaucaucgggcagcggaucgagaacaucaagaacgagcacaaguccaccuggcacuacgacgaggacaacccguacaagaccugggccuaccacggcagcuacgaggugaagcccuccgggagcgccuccagcauggucaacggcguggugcgccuccugacgaagcccugggacgucauccccauggugacccagaucgcgaugaccgacaccacgccguucgggcagcagcggguguucaaggagaaggucgacacccgcacgccccgggccaagcgcggcaccacgcagaucauggaggugaccgccaaguggcuguggggcuuccucucccggaacaagaagccccgcaucugcacccgggaggaguucacccgcaaggugcggagcaacgccgccaucggggcggucuucguggacgagaaccaguggaacagcgccaaggaggccguggaggacgagcgcuucugggaccugguccaccgggagcgcgagcugcacaagcagggcaagugcgccacgugcguguacaacaugauggggaagcgggagaagaagcucggcgaguucgggaaggcgaagggcucccgcgccaucugguacauguggcugggcgcccgguuccuggaguucgaggcccucggguucaugaacgaggaccacugguucagccgcgagaacucccugagcggcguggagggggagggccugcacaagcucggguacauccugcgggacaucuccaagaucccgggcggcaacauguacgccgacgacaccgcggggugggacacccgcaucaccgaggacgaccugcagaacgaggccaagaucacggacaucauggagcccgagcacgcccuccuggccaccagcaucuucaagcugaccuaccagaacaaggucgugcgcgugcagcggcccgccaagaacggcaccgucauggacgugaucucccgccgggaccagcgcgggagcggccaggugggcacguacgggcucaacaccuucaccaacauggagguccagcugauccggcagauggaguccgagggcaucuuccugcccagcgagcucgagaccccgaaccuggcggagcgcgcccuggacuggcucgagaagcacggggccgagcggcugaagcgcauggccaucuccggcgacgacugcguggugaagcccaucgacgaccgguucgccacggcgcugaccgcccucaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcugguggggcgggcccgcgugagccagggcgccggguggucccuccgggagaccgccugccugggcaagagcuacgcgcagauguggcagcugauguacuuccaccgccgggaccuccgccuggccgccaacgccaucugcuccgcgguccccguggacugggugcccgccagccggaccaccuggagcauccacgcccaccaccaguggaugacgaccgaggacaugcuguccgucuggaaccgcguguggaucgaggagaacccguggauggaggacaagacccacgugagcuccugggaggagguccccuaccucgggaagcgcgaggaccaguggugcggcagccugaucggccugaccgcccgggccacgugggcgaccaacauccagguggccaucaaccaggugcgccggcucaucgggaacgagaacuaccuggacuacaugaccuccaugaagcgcuucaagaacgagagcgaccccgagggcgcccugugguga

SEQ ID NO: 8865 - RNA, 9879 nt, Artificial Sequence
  derived and/or modified CDS sequence (opt1) from DENV-1__KC692502__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcggguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccgucgggaagcucgugcaccagguguucggcaccgccuacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgugcggaccacgcugucccuggacuacgccuggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgucagcauccugcuguccagccuccugaagaacgacgugccccuggcgggcccgcucaucgccggcgggaugcugaucgccugcuacgugaucagcggcuccagcgccgaccugucccucgagaaggccgcggaggucagcugggagcaggaggccgagcacuccggggccagccacaacauccugguggaggugcaggacgacggcacgaugaagaucaaggacgaggagcgggacgacacccugaccauccuccugaaggccacccugcucgccgucuccgggguguaccccaugagcauccccgcgacgcuguucgugugguacuucuggcagaagaagaagcagcgcuccggcguccugugggacacccccagcccgcccgagauggagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccugcccgagaucgaggacgagguguucaagaagcggaaccucaccaucauggaccugcacccgggcagcggcaagacccgccgguaccugcccgccaucgugcgcgaggccaucaagcgcaagcuccggacccugauccuggcccccacgcgcgucguggcguccgagauggccgaggcccucaaggggaugcccauccgguaccagaccaccgccgucaagagcgagcacaccggccgcgagaucgucgaccugaugugccacgccacguucaccaugcggcugcucuccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcugagccggaagacguucgacaccgaguaccagaagaccaagaacaacgacugggacuacgucgugaccacggacaucuccgagaugggcgccaacuuccgcgccgaccgggugaucgacccccgccggugccucaagcccgucauccugaaggacgggcccgagcgcgugauccuggccggcccgaugcccgucaccguggcgagcgccgcccagcggcgcggccgcaucgggcggaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucgucgagcugaugcgccggggcgaccuccccguguggcugagcuacaagguggccuccgagggguuccaguacagcgaccgccgguggugcuucgacggcgagcgcaacaaccagguccuggaggagaacauggacguggagaucuggaccaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggucaugcugcacaacuccgagcagggcgggaaggccuaccggcacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcgccacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcggaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcgcacgaccugggcccucugcgaguccaucacccuggcgaccggcccgcugacgacccucugggaggggagccccggcaaguucuggaacaccaccaucgccgucuccauggccaacaucuuccggggcagcuaccuggccggggccggccuggcguucucccucaugaagucccucgggggcgggcgccgggggacgggcgcccagggggagacccugggcgagaaguggaagcgccagcucaaccagcuguccaagagcgaguucaacaccuacaagcggagcgggaucauggagguggaccgcuccgaggccaaggagggccugaagcgcggggagaccacgaagcacgccgugagccgcggcaccgcgaagcuccggugguucgucgagcgcaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccgcacccugcgggugcugaagaugguggagcccuggcuccgcggcaaccaguucugcaucaagauccugaaccccuacaugccguccgucguggagacccuggagcagaugcagcggaagcacgggggcaugcucgugcgcaacccccugagccggaacuccacgcacgagauguacugggucagcugcgggaccggcaacaucguguccgccgugaacaugaccagccgcaugcugcucaaccgcuucaccauggcccaccggaagcccacguacgagcgcgacgucgaccugggcgcggggacccggcacguggccguggagcccgaggucgccaaccuggacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcuccugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcuguggggguuccucucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgccgacgacaccgcgggcugggacacccgcaucaccgaggacgaccugcagaacgaggccaagaucacggacaucauggagcccgagcacgcccuccuggccaugagcaucuucaagcugaccuaccagaacaaggucgugcgggugcagcgccccgccaagaacgggaccgucauggacgugaucucccggcgcgaccagcggggcagcggccagguggggaccuacggccucaacacguucaccaacauggagguccagcugauccgccagauggaguccgaggggaucuuccugcccagcgagcucgagaccccgaaccuggcggagcgggcccuggacuggcucgagaagcacggcgccgagcgccugaagcggauggccaucuccggggacgacugcguggugaagcccaucgacgaccgcuucgccaccgcgcugacggcccucaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcgcagauguggcagcugauguacuuccaccggcgcgaccuccggcuggccgccaacgccaucugcuccgcgguccccguggacugggugcccgccagccgcaccaccuggagcauccacgcccaccaccaguggaugaccacggaggacaugcuguccgucuggaaccgcguguggaucgaggagaacccguggauggaggacaagacccacgugagcuccugggaggagguccccuaccucggcaagcgggaggaccaguggugcggcagccugaucgggcugaccgcccgcgccaccugggcgacgaacauccagguggccaucucccaggugcggcgccucaucggcaacgagaacuaccuggacuacaugaccagcaugaagcgguucaagaacgaguccgaccccgagggggcccugugguga

SEQ ID NO: 8866 - RNA, 9879 nt, Artificial Sequence
  derived and/or modified CDS sequence (opt1) from DENV-1__KC692503__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacacgugggucaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccacccgggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucaccccccaggcccccacgagcgagauccagcugaccgacuacggggcccugacccucgacugcuccccccgcaccggccuggacuucaacgagaugguccugcucacgaugaaggagaagagcuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggaccggcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccccccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaagagcuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaucugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccuccccccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaucgggacccucgccgucuuccugcugcucaucaugggccagcugacguggaacgaccugauccgccucugcaucauggugggggccaacgcguccgaccggaugggcaugggcaccaccuaccuggcccugauggccaccuucaagaugcgcccgauguucgccguggggcuccuguuccggcgccugacgagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggaccacgcugcugagccucaccuucgugaagaccacccugucccuggacuacgccuggaagacgaccgccauggugcucagcaucgucucccuguucccccugugccucagcaccaccucccagaagacgaccuggcugccggugcugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcaccaugaagaucaaggacgaggagcgggacgacacgcugaccauccuccugaaggccacccugcucgccguguccggggucuaccccaugagcauccccgcgacccuguucgugugguacuucuggcagaagaagaagcagcgcuccggcgugcugugggacacgcccagcccgcccgaggucgagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacaccggggaggagguccaggugaucgccguggagcccggcaagaacccgaagaacguccagacgacccccggcaccuucaagacccccgagggggaggugggcgcgaucgcccucgacuucaagcccgggacgagcggcuccccgaucgugaaccgcgaggagaagaucgucggccuguacgggaacggcguggugaccaccagcgggaccuacgucuccgccaucgcccaggccaaggcgagccaggagggcccccugcccgagaucgaggacgagguguucaagaagcggaaccucacgaucauggaccugcacccggggagcggcaagacccgccgguaccugcccgccaucgugcgcgaggccaucaagcgcaagcuccggacccugauccuggcccccacccgcgucguggcguccgagauggccgaggcccucaagggcaugcccauccgguaccagacgaccgccgugaagagcgagcacaccgggcgcgagaucgucgaccugaugugccacgccaccuucacgaugcggcugcucuccccggugcgcgugcccaacuacaacaugaucaucauggacgaggcgcacuucaccgaccccgccagcaucgccgcccggggcuacaucuccacccgcgucgggaugggcgaggccgcggccaucuucaugaccgccacgcccccggggagcguggaggccuucccccaguccaacgccgugauccaggacgaggagcgggacauccccgagcgcagcuggaacuccggcuacgacuggaucaccgacuuccccggcaagaccgucugguucgugccgagcaucaaguccgggaacgacaucgcgaacugccugcggaagaacggcaagcgcgugauccagcugagccggaagaccuucgacacggaguaccagaagaccaagaacaacgacugggacuacgucgugaccaccgacaucuccgagaugggggccaacuuccgcgccgaccgggugaucgacccccgccggugccucaagcccgucauccugaaggacggccccgagcgcgugauccuggccgggccgaugcccgucacgguggcgagcgccgcccagcggcgcggccgcaucggccggaaccagaacaaggagggggaccaguacguguacaugggccagccccucaacaacgacgaggaccacgcccacuggaccgaggccaagaugcugcuggacaacaucaacacccccgaggggaucaucccggcgcucuucgagcccgagcgcgagaaguccgccgccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggacgaaggagggcgagcggaagaagcuccgcccccgguggcuggacgcgcgcaccuacuccgacccgcuggcccuccgggaguucaaggaguucgccgccgggcgccggagcgugagcggcgaccugauccuggagaucggcaagcucccccagcaccugacccugcgcgcccagaacgcgcucgacaaccuggucaugcugcacaacuccgagcaggggggcaaggccuaccggcacgccauggaggagcuccccgacaccaucgagacccugaugcugcucgcccugaucgcggugcugacggggggcgugacccucuucuuccugagcgggaagggccugggcaagaccuccaucgggcuccugugcgucaccgccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucggccuccuguucaugauccugaccguggccgccaacgagauggggcuccuggagaccaccaagaaggaccugggcaucggguacgucgccgcggagaaccaccagcacgccacgaugcucgacguggaccugcacccggccagcgccuggacccuguacgccguggcgaccaccgucaucacgcccaugaugcgccacaccaucgagaacaccaccgccaacaucucccucacggccaucgccaaccaggccgcgauccugaugggccuggacaagggcuggcccaucagcaagauggacaucggggugccccuccuggcccugggcugcuacucccaggugaacccgcucacccugaccgccgccguccugaugcucguggcgcacuacgccaucaucgggcccggccugcaggccaaggccacccgcgaggcccagaagcggacggcggccgggaucaugaagaaccccaccguggacggcaucgucgccaucgaccuggaccccgugguguacgacgccaaguucgagaagcagcucggccagaucaugcugcugauccucugcaccagccagauccugcugaugcgcaccacgugggcccucugcgaguccaucacccuggcgaccgggccgcugaccacgcucugggagggcagccccgggaaguucuggaacaccaccaucgccgucuccauggccaacaucuuccggggcagcuaccuggccggcgccgggcuggcguucucccucaugaagagccugggcgggggccgccgggggaccggcgcccagggcgagacgcugggggagaaguggaagcgccagcucaaccagcuguccaagagcgaguucaacaccuacaagcggagcggcaucauggagguggaccgcuccgaggccaaggaggggcugaagcggggcgagaccaccaagcacgccgugagccgcgggacggcgaagcuccggugguucgucgagcgcaaccuggugaagcccgagggcaaggugaucgaccugggcugcgggcggggcgggugguccuacuacugcgccggccugaagaaggucaccgaggugaagggguacaccaagggcggccccgggcacgaggagccgauccccauggccaccuacggcuggaaccucgugaagcugcacagcgggaaggacgucuucuucaugccccccgagaagugcgacacccugcucugcgacaucggcgaguccagcccgaaccccacgaucgaggaggggcgcacccugcgggugcugaagaugguggagcccuggcuccgcggcaaccaguucugcaucaagauccugaaccccuacaugccguccgucguggagacccuggagcagaugcagcggaagcacggcgggaugcucgugcgcaacccccugagccggaacuccacccacgagauguacugggucagcugcggcacggggaacaucguguccgccgugaacaugaccagccgcaugcugcucaaccgcuucaccauggcccaccggaagcccaccuacgagcgcgacgucgaccugggcgcgggcacgcggcacguggccguggagcccgaggucgccaaccuggacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcguggugcggcuccugaccaagcccugggacgucauccccauggugacgcagaucgcgaugaccgacaccaccccguucgggcagcagcgcguguucaaggagaaggucgacacgcggaccccccgcgccaagcggggcaccacccagaucauggaggugacggccaaguggcuguggggcuuccucucccgcaacaagaagccccggaucugcacccgcgaggaguucacccggaaggugcgcagcaacgccgccaucggggcggucuucguggacgagaaccaguggaacagcgccaaggaggccguggaggacgagcgguucugggaccugguccaccgcgagcgggagcugcacaagcagggcaagugcgccaccugcguguacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgccgacgacacggcggggugggacacccgcaucaccgaggacgaccugcagaacgaggccaagaucaccgacaucauggagcccgagcacgcccuccuggccacgagcaucuucaagcugaccuaccagaacaaggucgugcgggugcagcgccccgccaagaacggcaccgucauggacgugaucucccggcgcgaccagcgggggagcggccaggugggcaccuacgggcucaacacguucaccaacauggagguccagcugauccgccagauggaguccgagggcaucuuccugcccagcgagcucgagaccccgaaccuggcggagcgggcccuggacuggcucgagaagcacggggccgagcgccugaagcggauggccaucuccggcgacgacugcguggugaagcccaucgacgaccgcuucgccaccgcgcugacggcccucaacgacauggggaagguccggaaggacaucccccagugggagcccagcaagggcuggaacgacuggcagcaggugccguucugcucccaccacuuccaccagcugaucaugaaggacggccgcgagaucgugguccccugccggaaccaggacgagcugguggggcgcgcccgggugagccagggcgccggguggucccuccgcgagaccgccugccugggcaagagcuacgcgcagauguggcagcugauguacuuccaccggcgcgaccuccggcuggccgccaacgccaucugcuccgcgguccccguggacugggugcccgccagccgcaccaccuggagcauccacgcccaccaccaguggaugaccacggaggacaugcuguccgucuggaaccgcguguggaucgaggagaacccguggauggaggacaagacccacgugagcuccugggaggagguccccuaccucgggaagcgggaggaccaguggugcggcagccugaucggccugaccgcccgcgccaccugggcgacgaacauccagguggccaucaaccaggugcggcgccucaucgggaacgagaacuaccuggacuacaugaccuccaugaagcgguucaagaacgagagcgaccccgagggcgcccugugguga

SEQ ID NO: 8867 - RNA, 9879 nt, Artificial Sequence
  derived and/or modified CDS sequence (opt1) from DENV-1__KC692504__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgagaagcgguccguggcccuggcgccccacgugggccuggggcucgagacgcgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaugaaccccgcggugcugcgcaagcucugcaucgaggccaagaucagcaacaccaccaccgacucccggugccccacgcagggcgaggccacccugguggaggagcaggacgccaacuucgucugccgccggaccuucguggaccgcggcugggggaacggcugcgggcuguucggcaaggggagccuccugaccugcgccaaguucaagugcgugacgaagcuggagggcaagaucguccaguacgagaaccucaaguacuccgugaucgugaccguccacaccggcgaccagcaccagguggggaacgagaccacggagcacggcaccaucgcgaccaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccgccaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccggcugaagauggacaagcugacgcucaagggcauguccuacgucaugugcaccgggagcuucaagcuggagaaggagguggcggagacccagcacggcaccgugcugguccaggugaaguacgagggcacggacgcccccugcaagauccccuucuccacccaggacgagaagggggugacccagaacggccgccugaucaccgccaacccgaucgucacggacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacaccgcgugggacuucgggagcaucggcggcguguucacguccguggggaagcucguccaccagguguucggcaccgccuacggggugcuguucagcggcgucuccuggaccaugaagaucgggaucggcauccugcucaccuggcugggccugaacagccgcuccacgagccucuccaugaccugcaucgccguggggauggugacccuguaccugggcgucauggugcaggccgacagcgggugcgugaucaacuggaagggccgggagcucaagugcggguccggcaucuucgucaccaacgaggugcacacguggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacaccacguucaucaucgacgggcccgacaccccggagugccccgacggccagcgcgccuggaacaucugggaggucgaggacuacggguucggcguguucaccaccaacaucuggcugaagcugcgggacuccuacacgcagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaccuggcccaagagccacacgcugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcaccacgguggucguggacgagcacugcgggaaccggggcccgagccugcgcaccaccaccgugacggggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacccucgccgucuuccugcugcucaucaugggccagcugacguggaacgaccugauccgccucugcaucauggugggggccaacgcguccgaccggaugggcaugggcaccaccuaccuggcccugauggccaccuucaagaugcgcccgauguucgccguggggcuccuguuccggcgccugacgagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggaccacgcugcugagccucaccuucgugaagaccacccugucccuggacuacgccuggaagacgaccgccauggugcucagcaucgucucccuguucccccugugccucagcaccaccucccagaagacgaccuggcugccggugcugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcaccaugaagaucaaggacgaggagcgggacgacacgcugaccauccuccugaaggccacccugcucgccguguccggggucuaccccaugagcauccccgcgacccuguucgugugguacuucuggcagaagaagaagcagcgcuccggcgugcugugggacacgcccagcccgcccgaggucgagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacaccggggaggagguccaggugaucgccguggagcccggcaagaacccgaagaacguccagacgacccccggcaccuucaagacccccgagggggaggugggcgcgaucgcccucgacuucaagcccgggacgagcggcuccccgaucgugaaccgcgagggcaagaucgucgggcuguacggcaacgggguggugaccaccagcggcaccuacgucuccgccaucgcccaggccaaggcgagccaggaggggccccugcccgagaucgaggacgagguguucaagaagcggaaccucacgaucauggaccugcacccgggcagcggcaagacccgccgguaccugcccgccaucgugcgcgaggccaucaagcgcaagcuccggacccugauccuggcccccacccgcgucguggcguccgagauggccgaggcccucaaggggaugcccauccgguaccagacgaccgccgucaagagcgagcacaccggccgcgagaucgucgaccugaugugccacgccaccuucacgaugcggcugcucuccccggugcgcgugcccaacuacaacaugaucaucauggacgaggcgcacuucaccgaccccgccagcaucgccgcccggggguacaucuccacccgcgucggcaugggggaggccgcggccaucuucaugaccgccacgcccccgggcagcguggaggccuucccccaguccaacgccgugauccaggacgaggagcgggacauccccgagcgcagcuggaacuccggcuacgacuggaucaccgacuuccccgggaagaccgucugguucgugccgagcaucaaguccggcaacgacaucgcgaacugccugcggaagaacgggaagcgcgugauccagcugagccggaagaccuucgacacggaguaccagaagaccaagaacaacgacugggacuacgucgugaccaccgacaucuccgagaugggcgccaacuuccgcgccgaccgggugaucgacccccgccggugccucaagcccgucauccugaaggacgggcccgagcgcgugauccuggccggcccgaugcccgucacgguggcgagcgccgcccagcggcgcggccgcaucgggcggaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagaccuucgucgagcugaugcgccggggcgaccuccccguguggcugagcuacaagguggccuccgagggguuccaguacagcgaccgccgguggugcuucgacggcgagcgcaacaaccagguccuggaggagaacauggacguggagaucuggacgaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggucaugcugcacaacuccgagcagggcgggaaggccuaccggcacgccauggaggagcuccccgacaccaucgagacccugaugcugcucgcccugaucgcggugcugacgggcggggugacccucuucuuccugagcggcaagggccuggggaagaccuccaucggccuccugugcgucaccgccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagaccaccaagaaggaccuggggaucggcuacgucgccgcggagaaccaccagcacgccacgaugcucgacguggaccugcacccggccagcgccuggacccuguacgccguggcgaccaccgucaucacgcccaugaugcgccacaccaucgagaacaccaccgccaacaucucccucacggccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacccgcgaggcccagaagcggacggcggccggcaucaugaagaaccccaccguggacggcaucgucgccaucgaccuggaccccgugguguacgacgccaaguucgagaagcagcucgggcagaucaugcugcugauccucugcaccagccagauccugcugaugcgcaccacgugggcccucugcgaguccaucacccuggcgaccggcccgcugaccacgcucugggaggggagccccggcaaguucuggaacaccaccaucgccgucuccauggccaacguguuccggggcagcuaccuggccggggccggccuggcguucucccucaugaagucccucgggggcgggcgccgggggaccggcgcccagggggagacgcugggcgagaaguggaagcgccagcucaaccagcuguccaagagcgaguucaacaccuacaagcggagcgggaucauggagguggaccgcuccgaggccaaggagggccugaagcgcggggagaccaccaagcacgccgucagccgcggcacggcgaagcuccggugguucguggagcgcaaccuggugaagcccgagggcaaggucaucgaccuggggugcggccgcgggggcugguccuacuacugcgccgggcugaagaaggugaccgaggugaagggcuacaccaagggcgggcccggccacgaggagccgauccccauggccaccuacggguggaaccucgucaagcugcacagcggcaaggacguguucuucaugccgcccgagaagugcgacacccugcucugcgacaucggggaguccagcccgaaccccacgaucgaggagggccgcacccugcgggugcugaagauggucgagcccuggcuccgcggcaaccaguucugcaucaagauccugaaccccuacaugccguccgugguggagacccuggagcagaugcagcggaagcacgggggcaugcucguccgcaacccccugagccggaacuccacccacgagauguacugggugagcugcgggacgggcaacaucguguccgccgucaacaugaccagccgcaugcugcucaaccgcuucaccauggcccaccggaagcccaccuacgagcgcgacguggaccugggcgcggggacgcggcacguggccgucgagcccgagguggccaaccuggacaucaucggccagcgcaucgagaacaucaagaacgagcacaaguccaccuggcacuacgacgaggacaacccguacaagaccugggccuaccacgggagcuacgaggucaagcccuccggcagcgccuccagcauggugaacggggugguccggcuccugaccaagcccugggacgugauccccauggugacgcagaucgcgaugaccgacaccaccccguucggccagcagcgcgucuucaaggagaagguggacacgcggacgccccgggccaagcggggcaccacccagaucauggaggugacggccaaguggcuguggggguuccucucccgcaacaagaagccccggaucugcacccgcgaggaguucacccggaagguccgcagcaacgccgccaucggcgcgguguucguggacgagaaccaguggaacagcgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggcgaagggcucccgggccaucugguacauguggcugggggcccgcuuccuggaguucgaggcccucggcuucaugaacgaggaccacugguucagccgggagaacucccugagcggggucgagggcgaggggcugcacaagcucggcuacauccugcgcgacaucuccaagaucccgggcgggaacauguacgccgacgacacggcgggcugggacacccgcaucaccgaggacgaccugcagaacgaggccaagaucaccgacaucauggagcccgagcacgcccuccuggccacgagcaucuucaagcugaccuaccagaacaagguggugcggguccagcgccccgccaagaacgggaccgugauggacgugaucucccggcgcgaccagcggggcagcggccaggucgggaccuacggccucaacacguucaccaacauggaggugcagcugauccgccagauggaguccgaggggaucuuccugcccagcgagcucgagaccccgaaccuggcggagcgggcccuggacuggcucgagaagcacggcgccgagcgccugaagcggauggccaucuccggggacgacugcguggucaagcccaucgacgaccgcuucgccaccgcgcugacggcccucaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcuggugggccgcgcccgggucagccagggggccggcuggucccuccgcgagaccgccugccugggcaagagcuacgcgcagauguggcagcugauguacuuccaccggcgcgaccuccggcuggccgccaacgccaucugcuccgcggugcccguggacuggguccccgccagccgcaccaccuggagcauccacgcccaccaccaguggaugaccacggaggacaugcuguccguguggaaccgcguguggaucgaggagaacccguggauggaggacaagacccacgucagcuccugggaggaggugcccuaccucggcaagcgggaggaccaguggugcggcagccugaucgggcugaccgcccgcgccaccugggcgacgaacauccagguggccaucaaccagguccggcgccucaucggcaacgagaacuaccuggacuacaugaccuccaugaagcgguucaagaacgagagcgaccccgagggggcccugugguga

SEQ ID NO: 8868 - RNA, 9879 nt, Artificial Sequence
  derived and/or modified CDS sequence (opt1) from DENV-1__KC692508__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgcgacgcuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgggagggcaagaucgucgggcuguacggcaacgggguggugaccaccagcggcacguacgucuccgccaucgcccaggccaaggcgagccaggaggggccccugcccgagaucgaggacgagguguucaagaagcgcaaccucaccaucauggaccugcacccgggcagcggcaagacccggcgcuaccugcccgccaucgugcgggaggccaucaagcgcaagcuccgcacccugauccuggcccccacgcgggucguggcguccgagauggccgaggcccucaaggggaugcccauccgcuaccagaccaccgccgucaagagcgagcacaccggccgggagaucgucgaccugaugugccacgccacguucaccaugcgccugcucuccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccucaagcccgucauccugaaggacgggcccgagcgggugauccuggccggcccgaugcccgucaccguggcgagcgccgcccagcgccggggccgcaucgggcgcaaccagaacaaggagggcgaccaguacguguacauggggcagccccucaacaacgacgaggagcacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggaccuacuccgacccgcuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcggcacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcggacgaccugggcccucugcgaguccaucacccuggcgaccggcccgcugacgacccucugggaggggagccccggcaaguucuggaacaccaccaucgccgucuccauggccaacaucuuccgcggcagcuaccuggccggggccggccuggcguucucccucaugaagucccucgggggcgggcggcgcggcacgggcgcccagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgugagccggggcaccgcgaagcuccgcugguucgucgagcggaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccggacccugcgcgugcugaagaugguggagcccuggcuccggggcaaccaguucugcaucaagauccugaaccccuacaugccguccgucguggagacccuggagcagaugcagcgcaagcacgggggcaugcucgugcggaacccccugagccgcaacuccacgcacgagauguacugggucagcugcgggaccggcaacaucguguccgccgugaacaugaccagccggaugcugcucaaccgcuucaccauggcccaccgcaagcccacguacgagcgggacgucgaccugggcgcggggacccgccacguggccguggagcccgaggucgccaaccuggacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccuccugacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcugugguccuuccucagccggaacaagaagccccgcaucugcacccgggaggaguucacccgcaaggugcggagcaacgccgccaucggggcggucuucguggacgagaaccaguggaacuccgccaaggaggccguggaggacgagcgcuucugggaccugguccaccgggagcgcgagcugcacaagcagggcaagugcgccacgugcguguacaacaugauggggaagcgggagaagaagcucggcgaguucgggaaggcgaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagaucccgggcggcaacauguacgccgacgacaccgcggggugggacacccgcaucaccgaggacgaccugcagaacgaggccaagaucacggacaucauggagcccgagcacgcccuccuggccaccuccaucuucaagcugaccuaccagaacaaggucgugcgcgugcagcggcccgccaagaacggcaccgucauggacgugaucagccgccgggaccagcgcggguccggccaggugggcacguacgggcucaacaccuucaccaacauggagguccagcugauccggcagauggagagcgagggcaucuuccugcccuccgagcucgagaccccgaaccuggcggagcgcgcccuggacuggcucgagaagcacggggccgagcggcugaagcgcauggccaucagcggcgacgacugcguggugaagcccaucgacgaccgguucgccacggcgcugaccgcccucaacgacauggggaagguccgcaaggacaucccccagugggagcccuccaagggcuggaacgacuggcagcaggucccguucugcagccaccacuuccaccagcugaucaugaaggacggccgggagaucgugguccccugccgcaaccaggacgagcugguggggcgggcccgcgugucccagggcgccggguggagccuccgggagaccgccugccugggcaaguccuacgcgcagauguggcagcugauguacuuccaccgccgggaccuccgccuggccgccaacgccaucugcagcgcgguccccguggacugggugcccgccagccggaccaccugguccauccacgcccaccaccaguggaugacgaccgaggacaugcugagcgucuggaaccgcguguggaucgaggagaacccguggauggaggacaagacccacguguccagcugggaggagguccccuaccucgggaagcgcgaggaccaguggugcggcucccugaucggccugaccgcccgggccacgugggcgaccaacauccagguggccaucaaccaggugcgccggcucaucgggaacgagaacuaccuggacuacaugaccagcaugaagcgcuucaagaacgaguccgaccccgagggcgcccugugguga

SEQ ID NO: 8869 - RNA, 9879 nt, Artificial Sequence
  derived and/or modified CDS sequence (opt1) from DENV-1__KC692509__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcggguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccgucgggaagcucgugcaccagguguucggcaccgccuacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgugcggaccacgcugucccuggacuacgccuggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgucagcauccugcuguccagccuccugaagaacgacgugccccuggcgggcccgcucaucgccggcgggaugcugaucgccugcuacgugaucagcggcuccagcgccgaccugucccucgagaaggccgcggaggucagcugggagcaggaggccgagcacuccggggccagccacaacauccugguggaggugcaggacgacggcacgaugaagaucaaggacgaggagcgggacgacacccugaccauccuccugaaggccacccugcucgccgucuccgggguguaccccaugagcauccccgcgacgcuguucgugugguacuucuggcagaagaagaagcagcgcuccggcguccugugggacacccccagcccgcccgagauggagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccugcccgagaucgaggacgagguguucaagaagcggaaccucaccaucauggaccugcacccgggcagcggcaagacccgccgguaccugcccgccaucgugcgcgaggccaucaagcgcaagcuccggacccugauccuggcccccacgcgcgucguggcguccgagauggccgaggcccucaaggggaugcccauccgguaccagaccaccgccgucaagagcgagcacaccggccgcgagaucgucgaccugaugugccacgccacguucaccaugcggcugcucuccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcugagccggaagacguucgacaccgaguaccagaagaccaagaacaacgacugggacuacgucgugaccacggacaucuccgagaugggcgccaacuuccgcgccgaccgggugaucgacccccgccggugccucaagcccgucauccugaaggacgggcccgagcgcgugauccuggccggcccgaugcccgucaccguggcgagcgccgcccagcggcgcggccgcaucgggcggaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucgucgagcugaugcgccggggcgaccuccccguguggcugagcuacaagguggccuccgagggguuccaguacagcgaccgccgguggugcuucgacggcgagcgcaacaaccagguccuggaggagaacauggacguggagaucuggaccaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggucaugcugcacaacuccgagcagggcgggaaggccuaccggcacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcgccacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcggaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcgcacgaccugggcccucugcgaguccaucacccuggcgaccggcccgcugacgacccucugggaggggagccccggcaaguucuggaacaccaccaucgccgucuccauggccaacaucuuccggggcagcuaccuggccggggccggccuggcguucucccucaugaagucccucgggggcgggcgccgggggacgggcgcccagggggagacccugggcgagaaguggaagcgccagcucaaccagcuguccaagagcgaguucaacaccuacaagcggagcgggaucauggagguggaccgcuccgaggccaaggagggccugaagcgcggggagaccacgaagcacgccgugagccgcggcaccgcgaagcuccggugguucgucgagcgcaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccgcacccugcgggugcugaagaugguggagcccuggcuccgcggcaaccaguucugcaucaagauccugaaccccuacaugccguccgucguggagacccuggagcagaugcagcggaagcacgggggcaugcucgugcgcaacccccugagccggaacuccacgcacgagauguacugggucagcugcgggaccggcaacaucguguccgccgugaacaugaccagccgcaugcugcucaaccgcuucaccauggcccaccggaagcccacguacgagcgcgacgucgaccugggcgcggggacccggcacguggccguggagcccgaggucgccaaccuggacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcuccugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcuguggggguuccucucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgccgacgacaccgcgggcugggacacccgcaucaccgaggacgaccugcagaacgaggccaagaucacggacaucauggagcccgagcacgcccuccuggccaccagcaucuucaagcugaccuaccagaacaaggucgugcgggugcagcgccccgccaagaacgggaccgucauggacgugaucucccggcgcgaccagcggggcagcggccagguggggacguacggccucaacaccuucaccaacauggagguccagcugauccgccagauggaguccgaggggaucuuccugcccagcgagcucgagaccccgaaccuggcggagcgggcccuggacuggcucgagaagcacggcgccgagcgccugaagcggauggccaucuccggggacgacugcguggugaagcccaucgacgaccgcuucgccacggcgcugaccgcccucaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcgcagauguggcagcugauguacuuccaccggcgcgaccuccggcuggccgccaacgccaucugcuccgcgguccccguggacugggugcccgccagccgcaccaccuggagcauccacgcccaccaccaguggaugacgaccgaggacaugcuguccgucuggaaccgcguguggaucgaggagaacccguggauggaggacaagacccacgugagcuccugggaggagguccccuaccucggcaagcgggaggaccaguggugcggcagccugaucgggcugaccgcccgcgccacgugggcgaccaacauccagguggccaucucccaggugcggcgccucaucggcaacgagaacuaccuggacuacaugaccagcaugaagcgguucaagaacgaguccgaccccgagggggcccugugguga

SEQ ID NO: 8870 - RNA, 9879 nt, Artificial Sequence
  derived and/or modified CDS sequence (opt1) from DENV-1__KC692510__SS-prME
agcgugaccaugcugcucaugcugcugcccaccgcgcucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacguucaagaugcgcccgauguucgccguggggcuccuguuccggcgccugaccagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgggacgacacccugaccauccuccugaaggccacccugcucgccguguccggggucuaccccaugagcauccccgcgacgcuguucgugugguacuucuggcagaagaagaagcagcgcuccggcgugcugugggacacccccagcccgcccgaggucgagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccugcccgagaucgaggacgagguguucaagaagcggaaccucaccaucauggaccugcacccgggcagcggcaagacccgccgguaccugcccgccaucgugcgcgaggccaucaagcgcaagcuccggacccugauccuggcccccacgcgcgucguggcguccgagauggccgaggcccucaaggggaugcccauccgguaccagaccaccgccgucaagagcgagcacaccggccgcgagaucgucgaccugaugugccacgccacguucaccaugcggcugcucuccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcugagccggaagacguucgacaccgaguaccagaagaccaagaacaacgacugggacuacgucgugaccacggacaucuccgagaugggcgccaacuuccgcgccgaccgggugaucgacccccgccggugccucaagcccgucauccugaaggacgggcccgagcgcgugauccuggccggcccgaugcccgucaccguggcgagcgccgcccagcggcgcggccgcaucgggcggaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucgucgagcugaugcgccggggcgaccuccccguguggcugagcuacaagguggccuccgagggguuccaguacagcgaccgccgguggugcuucgacggcgagcgcaacaaccagguccuggaggagaacauggacguggagaucuggaccaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggucaugcugcacaacuccgagcagggcgggaaggccuaccggcacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcgccacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcggaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcgcacgaccugggcccucugcgaguccaucacccuggcgaccggcccgcugacgacccucugggaggggagccccggcaaguucuggaacaccaccaucgccgucuccauggccaacaucuuccggggcagcuaccuggccggggccggccuggcguucucccucaugaagucccucgggggcgggcgccgggggacgggcgcccagggggagacccugggcgagaaguggaagcgccagcucaaccagcuguccaagagcgaguucaacaccuacaagcggagcgggaucauggagguggaccgcuccgaggccaaggagggccugaagcgcggggagaccacgaagcacgccgugagccgcggcaccgcgaagcuccggugguucgucgagcgcaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccgcacccugcgggugcugaagaugguggagcccuggcuccgcggcaaccaguucugcaucaagauccugaaccccuacaugccguccgucguggagacccuggagcagaugcagcggaagcacgggggcaugcucgugcgcaacccccugagccggaacuccacgcacgagauguacugggucagcugcgggaccggcaacaucguguccgccgugaacaugaccagccgcaugcugcucaaccgcuucaccauggcccaccggaagcccacguacgagcgcgacgucgaccugggcgcggggacccggcacguggccguggagcccgaggucgccaaccuggacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcuccugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcuguggggguuccucucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgccgacgacaccgcgggcugggacacccgcaucaccgaggacgaccugcagaacgaggccaagaucacggacaucauggagcccgagcacgcccuccuggccaccagcaucuucaagcugaccuaccagaacaaggucgugcgggugcagcgccccgccaagaacgggaccgucauggacgugaucucccggcgcgaccagcggggcagcggccagguggggacguacggccucaacaccuucaccaacauggagguccagcugauccgccagauggaguccgaggggaucuuccugcccagcgagcucgagaccccgaaccuggcggagcgggcccuggacuggcucgagaagcacggcgccgagcgccugaagcggauggccaucuccggggacgacugcguggugaagcccaucgacgaccgcuucgccacggcgcugaccgcccucaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcgcagauguggcagcugauguacuuccaccggcgcgaccuccggcuggccgccaacgccaucugcuccgcgguccccguggacugggugcccgccagccgcaccaccuggagcauccacgcccaccaccaguggaugacgaccgaggacaugcuguccgucuggaaccgcguguggaucgaggagaacccguggauggaggacaagacccacgugagcuccugggaggagguccccuaccucggcaagcgggaggaccaguggugcggcagccugaucgggcugaccgcccgcgccacgugggcgaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8871 - RNA, 9879 nt, Artificial Sequence
  derived and/or modified CDS sequence (opt1) from DENV-1__KC692511__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagaagguggagaacugggcccugcggcaccccggguucaccgugaucgcccuguuccucgcccacgcgaucggcacgagcaucacccagaaggggaucaucuucauccugcugaugcucgucacccccuccauggccaugcgcugcgugggcaucggcaaccgggacuucguggaggggcugagcggcgccaccugggucgacguggugcuggagcacggguccugcgucacgaccauggccaagaacaagcccacccucgacaucgagcugcugaagaccgaggugacgaaccccgccgugcuccgcaagcugugcaucgaggcgaagaucagcaacaccaccaccgacucccggugcccgacgcagggcgaggccacccuggucgaggagcaggacgccaacuucgugugccgccggaccuucguggaccgcggcugggggaacggcugcggccucuucggcaaggggagccugcugaccugcgccaaguucaagugcgucacgaagcucgagggcaagaucgugcaguacgagaaccugaaguacuccgugaucgucaccgugcacaccggcgaccagcaccaggucgggaacgagaccacggagcacggcaccaucgccaccaucacgccccaggcgcccaccagcgagauccagcugacggacuacggggcccucacccuggacugcagcccccggaccggccuggacuucaacgagauggugcuccugaccaugaaggagaaguccuggcuggugcacaagcagugguuccucgaccugccgcugcccuggacguccggggccagcaccagccaggagaccuggaaccgccaggaccuccuggucaccuucaagacggcccacgccaagaagcaggagguggugguccugggcucccaggagggcgcgaugcacaccgcccucaccggggccaccgagauccagacgagcggcaccaccaccaucuucgccgggcaccugaagugccggcugaagauggacaagcucacgcugaagggcauguccuacgugaugugcaccgggagcuucaagcuggagaaggagguggccgagacccagcacggcaccguccugguccaggugaaguacgagggcacggacgcgcccugcaagauccccuuccucacccaggacgagaagggggucacccagaacggccgccugaucaccgccaacccgaucgugacggacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacaccgccugggacuucggguccaucggcggccuguucacgagcguggggaagcucauccaccagaucuucggcaccgcguacgggguccuguucuccggcgugagcuggaccaugaagaucgggaucggcauccugcucaccuggcugggccugaacucccgcagcacgucccucagcaugaccugcaucgccguggggauggucacccuguaccugggcgugauggugcaggccgacuccgggugcgucaucaacuggaagggccgcgagcucaagugcgggagcggcaucuucgugaccaacgaggugcacacguggaccgagcaguacaaguuccaggccgacuccccgaagcggcugagcgccgcgaucggcaaggccugggaggagggggucugcggcauccgcagcgccacccggcuggagaacaucauguggaagcagaucuccaacgagcucaacuacauccugcuggagaacgacaugaaguucaccgugguggucggggacaucaacggcauccucgcccaggggaagaagaugauccgcccccagcccauggagcacaaguacagcuggaaguccuggggcaaggccaagaucaucggcgcggacauccagaacaccacguucaucaucgacgggcccgacaccccggagugccccaacgaccagcgggccuggaacaucugggagguggaggacuacggcuucgggaucuucaccaccaacaucuggcugaagcugcgcgacagccacacgcagaugugcgaccaccggcucauguccgccgccaucaaggacagcaaggcggugcacgccgacaugggcuacuggaucgaguccgagaagaacgagaccuggaagcuggcccgcgccagcuucaucgaggucaagaccugcaucuggcccaagucccacacccuguggagcaacggcgugcucgaguccgagauggugauccccaagaucuacgggggcccgaucagccagcacaacuaccggcccggguacuucacgcagaccgccggccccuggcaccuggggaagcuggagcucgacuucgaccugugcgagggcaccaccgucgugguggacgagcacugcggcuaccgcgggccgucccugcggacgaccaccgucaccggcaagaucauccacgaguggugcugccgcagcugcacgcugccgccccugcgguuccgcggggaggacggcugcugguacgggauggagauccggcccgugaaggagaaggaggagaaccuggugcgcuccauggucagcgcgggcuccggcgagguggacagcuucagccucgggauccugugcguguccauccugaucgaggaggucaugcggagccgcuggucccggaagaugcucaugaccggcacccuggccguguuccugcuccugaucauggggcagcugaccuggaacgaccucauccgccugugcaucauggugggcgccaacgccagcgaccgcauggggaugggcacgaccuaccuggcccucauggccaccuucaagaugcggccgauguucgccgucgggcugcuguuccgccggcucaccucccgcgaggugcugcugcucacgguggggcugagccuggucgccuccguggagcuccccaacagccuggaggagcugggcgacgggcucgccaugggcaucaugaugcugaagcugcucaccgacuuccagccccaccagcuguggaccacccugcucucccugacguucauccggaccagccugucccucgacuacgccuggaagaccauggcgauggcccugagcaucgucucccuguucccccucugccugagcaccacgucccagaagaccaccuggcugccggugcuccugggcagcuucgggugcaagccccugaccauguuccucaucacggagaacaagaucuggggccgcaaguccuggcccaucaacgaggggaucauggccgugggcaucgucagcauccugcuguccagccuccugaagaacgacgugccccuggccgggccgcucaucgcgggcggcaugcugaucgccugcuacgugaucagcggguccagcgccgaccugucccucgagaaggccgccgaggucagcugggaggaggaggcggagcacuccggcaccagccacaacauccugguggaggugcaggacgacgggaccaugaagaucaaggacgaggagcgggacgacacccugaccauccuccugaaggccacgcugcucgccgucuccggcguguaccccaugagcauccccgccacccuguucgugugguacuucuggcagaagaagaagcagcgcuccgggguccugugggacacccccagcccgcccgagguggagcgggccgugcuggacgacggcaucuaccgcauccuccagcggggccugcuggggcgcucccaggucggcguggggguguuccaggacggcgucuuccacaccauguggcacgugacgcgcggggcggugcucauguaccagggcaagcgccuggagcccagcugggccuccgucaagaaggaccugaucagcuacggcgggggcuggcgguuccagggguccuggaacaccggcgaggagguccaggugaucgccgucgagcccgggaagaacccgaagaacgugcagaccacccccggcacguucaagacccccgagggcgaggugggggccaucgcccucgacuucaagcccggcaccagcggguccccgaucgucaaccgcgagggcaagaucgugggccuguacgggaacggcguggucaccacgagcgggaccuacguguccgcgaucgcccaggccaaggccacccaggagggcccccugcccgagaucgaggacgagguguucaagaagcggaaccucaccaucauggaccugcacccggggagcggcaagacgcgccgguaccugcccgccaucguccgcgaggcgaucaagcggaagcuccgcacccugauccuggcccccacccgcgugguggccagcgagauggccgaggcgcucaagggcaugcccauccgguaccagaccacggccgucaaguccgagcacaccgggcgcgagaucguggaccugaugugccacgccaccuucaccaugcggcugcucagcccggugcgcguccccaacuacaacaugaucaucauggacgaggcccacuucacggaccccgccuccaucgcggcccggggcuacaucagcacccgcguggggaugggcgaggccgccgccaucuucaugaccgcgacgccgcccggguccguggaggccuucccccagagcaacgccgucauccaggacgaggagcgggacauccccgagcgcuccuggaacagcggcuacgacuggaucacggacuuccccggcaagaccgugugguucgugcccuccaucaagagcgggaacgacaucgccaacugccugcggaagaacggcaagcgcgucauccagcugucccggaagaccuucgacaccgaguaccagaagacgaagaacaacgacugggacuacguggugaccaccgacaucagcgagaugggggccaacuuccgcgcggaccgggucaucgacccccgccggugccucaagcccgugauccugaaggagggccccgagcgcgugauccuggccgggccgaugcccgucaccguggccuccgccgcgcagcggcgcggccggaucggccgcaaccagaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgcgaucgacggcgaguaccggcugcgcggggaggcccggaagaccuucgucgagcugaugcgccggggcgaccuccccguguggcuguccuacaagguggccagcgagggcuuccaguacuccgaccgccgguggugcuucgacggggagcgcaacaaccagguccuggaggagaacauggacguggagaucuggaccaaggagggcgagcggaagaagcuccgcccccgguggcuggacgcccgcacguacagcgacccgcuggcccuccgggaguucaaggaguucgcggccgggcgccgguccgugagcggcgaccugauccuggagaucggcaagcucccccagcaccugacccugcgcgcccagaacgcccucgacaaccuggucaugcugcacaacagcgagcagggcgggaaggccuaccggcacgcgauggaggagcuccccgacaccaucgagacccugaugcugcucgcccugaucgccgugcugaccgggggcgugacccucuucuuccuguccgggaagggccugggcaagaccagcaucgggcuccugugcgucauggccuccagcgcgcugcucuggauggccuccguggagccccacuggaucgccgccagcaucauccuggaguucuuccugauggugcuccugaucccggagcccgaccgccagcggacgccccaggacaaccagcuggccuacgucgugaucggccuccuguucaugauccugaccguggcggccaacgagauggggcuccuggagacgaccaagaaggaccugggcaucgggcacgucgccguggagaaccaccaccacgccaccaugcucgacguggaccugcgcccggccuccgcguggacccuguacgccgucgccacgaccgugaucacccccaugaugcggcacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccgcucacccugacggccgcggugcugaugcucguggcccacuacgccaucaucgggcccggccugcaggccaaggcgacccgcgaggcccagaagcgcaccgccgccgggaucaugaagaaccccaccgucgacggcaucgugacgaucgaccuggaccccguggucuacgacgccaaguucgagaagcagcucggccagaucaugcugcugauccucugcaccucccagauccugcugaugcggaccaccugggcgcucugcgagagcaucacgcuggccaccgggccgcugaccacccucugggagggcucccccgggaaguucuggaacacgaccaucgccgugagcauggccaacaucuuccgcggcuccuaccuggccggcgcggggcuggccuucagccucaugaagucccugggcgggggccggcgcgggaccggcgcccagggcgagacccugggggagaaguggaagcggcagcucaaccagcugagcaaguccgaguucaacacguacaagaaguccggcaucauggagguggaccgcagcgaggccaaggaggggcugaagcggggcgagaccaccaagcacgccgucucccgcgggaccgcgaagcugcggugguucguggagcgcaaccucgugaagcccgagggcaaggucaucgaccugggcugcgggcggggcggguggagcuacuacugcgccggccugaagaaggugacggaggugaagggguacaccaagggcggccccgggcacgaggagccgauccccauggccaccuacggcuggaaccucgucaagcugcacuccgggaaggacguguucuucacgccgcccgagaagugcgacacccugcucugcgacaucggcgagagcuccccgaaccccacgaucgaggaggggcgcacccugcgggugcugaagauggucgagcccuggcuccgcggcaaccaguucugcaucaagauccugaaccccuacaugccgagcgugguggagacccuggagcagaugcagcggaagcacggcgggaugcucguccgcaacccccugucccggaacagcacccacgagauguacuggguguccugcggcacggggaacaucgugagcgccgucaacaugaccucccgcaugcugcucaaccgguucaccauggcgcaccgcaagcccaccuacgagcgcgacguggaccugggcgccggcacgcggcacguggccgucgagcccgagguggccaaccuggacaucaucgggcagcgcaucgagaacaucaagaacgagcacaagagcaccuggcacuacgacgaggacaacccguacaagaccugggccuaccacggcuccuacgaggugaagcccagcggguccgcgagcuccauggucaacggcgugguccggcuccugaccaagcccugggacgugauccccauggugacgcagaucgccaugaccgacaccaccccguucgggcagcagcgcgucuucaaggagaagguggacacgcggacgccccgggccaagcggggcaccgcccagaucauggaggugaccgccaaguggcuguggggcuuccucagccgcaacaagaagccccggaucugcacgcgcgaggaguucacccggaagguccgcuccaacgcggccaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacaccgccgggugggacacgcggaucaccgaggacgaccugcagaacgaggccaagaucaccgacaucauggagcccgagcacgcccuccuggcgaccuccaucuucaagcugacguaccagaacaagguggugcgcguccagcgccccgccaagagcggcaccgugauggacgugaucucccggcgcgaccagcgggggagcggccaggucggcaccuacgggcucaacaccuucacgaacauggaggugcagcugauccgccagauggaguccgagggcaucuucagccccuccgagcuggagaccccgaaccucgccaagaaggugcuggacuggcuggagaagcacggggccgagcggcucaagcgcauggccaucagcggcgacgacugcgucgugaagcccaucgacgaccgguucgcgaccgcccugaccgcccugaacgacauggggaaggugcgcaaggacaucccccagugggagcccuccaagggcuggaacgacuggcagcaggucccguucugcagccaccacuuccaccagcucaucaugaaggacggccgggagaucguggugcccugccgcaaccaggacgagcuggucgggcgggcccgcgugucccagggcgccggguggagccugcgggagacggcgugccucggcaaguccuacgcccagauguggcagcugauguacuuccaccgccgggaccugcgccucgccgccaacgccaucugcagcgcggugcccgucgacugggugcccaccagccggaccaccugguccauccacgcccaccaccaguggaugaccacggaggacaugcugagcguguggaaccgcgucuggaucgaggagaacccguggauggaggacaagacccacguguccagcugggaggaggugcccuaccuggggaagcgggaggaccaguggugcggcucccucaucggccugaccgcccgcgccaccugggcgacgaacauccaggucgccaucaaccaggugcgccggcugaucgggaacgagaacuaccucgacuacaugaccagcaugaagcgcuucaagaacgaguccgaccccgagggcgcccugugguga

SEQ ID NO: 8872 - RNA, 9879 nt, Artificial Sequence
  derived and/or modified CDS sequence (opt1) from DENV-1__KC692512__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagcgcgggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggggugcuggagagcgagaugaucauccccaagaucuucggcgggccgaucucccagcacaacuaccggcccggcuacuucacccagaccgccgggcccuggcaccugggcaagcucgagcuggacuucgaccugugcgagggcacgaccguggucguggacgagcacugcgggaaccgcggcccgagccuccggaccaccacggugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggcauccugugcgugagcaucaugaucgaggaggugaugcggucccgcuggagccgcaagaugcucaugaccgggacgcuggccgucuuccugcuccugaucaugggccagcugaccuggaacgaccucauccggcugugcaucauggugggggccaacgcguccgaccgcaugggcaugggcaccaccuaccuggcccucauggccacguucaagaugcggccgauguucgccguggggcugcuguuccgccggcucaccagccgcgagguccugcugcucaccaucgggcugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgcgacgacacccucaccauccugcugaaggccacccuccuggccguguccggggucuaccccaugagcauccccgcgacgcuguucgugugguacuucuggcagaagaagaagcagcgguccggcgugcucugggacacccccagcccgcccgaggucgagcgcgccgugcuggacgacggcaucuaccggauccugcagcgcgggcugcucggccggucccaggugggggucggcguguuccaggacgggguguuccacaccauguggcacgucacccgcggcgccgugcugauguaccagggcaagcggcuggagcccagcugggccuccgugaagaaggaccucaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgggaggagaagaucgucggccuguacgggaacggcguggugaccaccagcgggacguacgucuccgccaucgcccaggccaaggcgagccaggagggcccccuccccgagaucgaggacgagguguucaagaagcgcaaccugaccaucauggaccugcacccggggagcggcaagacccggcgcuaccuccccgccaucgugcgggaggccaucaagcgcaagcugcgcacccugauccucgcccccacgcgggucguggcguccgagauggccgaggcccugaagggcaugcccauccgcuaccagaccaccgccgucaagagcgagcacaccgggcgggagaucgucgaccugaugugccacgccacguucaccaugcgccuccuguccccggugcgggugcccaacuacaacaugaucaucauggacgaggcgcacuucaccgaccccgccagcaucgccgcccgcggcuacaucuccacccgggucgggaugggcgaggccgcggccaucuucaugacggccacgccgcccgggagcguggaggccuucccccaguccaacgccgugauccaggacgaggagcgcgacauccccgagcggagcuggaacuccggcuacgacuggaucaccgacuuccccggcaagaccgucugguucgugcccagcaucaaguccgggaacgacaucgcgaacugccugcgcaagaacggcaagcgggugauccagcucagccgcaagacguucgacaccgaguaccagaagaccaagaacaacgacugggacuacgucgugaccacggacaucuccgagaugggggccaacuuccgggccgaccgcgugaucgacccccggcgcugccugaagcccgucauccugaaggacggccccgagcgggugauccucgccgggccgaugcccgucaccguggcgagcgccgcccagcgccggggccgcaucggccgcaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgggagaaguccgccgccaucgacggcgaguaccgccugcgcggggaggcccgcaagacguucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacccuccgggcccagaacgcgcuggacaaccuggucaugcuccacaacuccgagcagggcgggaaggccuaccgccacgccauggaggagcugcccgacaccaucgagacgcugaugcuccuggcccugaucgcggugcucaccgggggcgugacccuguucuuccugagcgggaagggccucggcaagaccuccaucgggcugcugugcgucacggccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagaccacgaagaaggaccucggcaucgggcacgucgccgcggagaaccaccagcacagcaccaugcuggacguggaccugcacccggccuccgccuggacccucuacgccguggccaccacggucaucacccccaugaugcggcacaccaucgagaacaccacggcgaacaucagccugaccgccaucgccaaccaggccgccauccugaugggccucgacaagggcuggcccaucuccaagauggacaucggggugccccugcuggcgcucggcugcuacagccaggugaacccgcugacccugaccgccgccguccucaugcugguggcccacuacgcgaucaucgggcccggccugcaggccaaggccacgcgcgaggcccagaagcgcaccgccgcggggaucaugaagaaccccaccguggacggcaucgucgccaucgaccucgaccccgugguguacgacgccaaguucgagaagcagcugggccagaucaugcugcucauccugugcaccucccagauccugcucaugcggacgaccugggcccugugcgagagcaucacccuggccaccgggccgcucacgacccugugggagggcucccccgggaaguucuggaacaccaccaucgcggucagcauggccaacaucuuccgcggcuccuaccuggccggcgccgggcucgccuucagccugaugaagucccugggcgggggccggcgcgggacgggcgcgcagggcgagacccucggggagaaguggaagcggcagcugaaccagcugagcaagagcgaguucaacaccuacaagcgcuccggcaucauggagguggaccggagcgaggccaaggaggggcucaagcgcggcgagaccacgaagcacgccgugucccgggggaccgccaagcugcgcugguucgucgagcggaaccuggugaagcccgagggcaaggugaucgaccugggcugcgggcgcggcggguggagcuacuacugcgcgggccucaagaaggucaccgaggugaagggguacaccaagggcggccccgggcacgaggagccgauccccauggccaccuacggcuggaaccuggugaagcugcacuccgggaaggacgucuucuucaugccgcccgagaagugcgacacgcuccugugcgacaucggcgagagcuccccgaaccccaccaucgaggaggggcggacccugcgcgugcucaagaugguggagcccuggcugcggggcaaccaguucugcaucaagauccugaaccccuacaugccgagcgucguggagacccucgagcagaugcagcgcaagcacggcgggaugcuggugcggaacccccugucccgcaacagcacgcacgagauguacugggucuccugcggcaccgggaacaucgugagcgccgugaacaugaccucccggaugcuccugaaccgcuucaccauggcccaccgcaagcccacguacgagcgggacgucgaccugggcgccggcacccgccacguggcgguggagcccgaggucgccaaccucgacaucaucgggcagcggaucgagaacaucaagaacgagcaccgcagcaccuggcacuacgacgaggacaacccguacaagaccugggccuaccacggcuccuacgaggugaagcccagcggguccgccagcuccauggucaacggcguggugcggcugcugacgaagcccugggacgucauccccauggugacccagaucgccaugaccgacaccacgccguucgggcagcagcgcguguucaaggagaaggucgacacccggacgccccgggcgaagcggggcaccacgcagaucauggaggugaccgccaaguggcucuggggcuuccugagccgcaacaagaagccccggaucugcacccgcgaggaguucacccggaaggugcgcagcaacgccgccaucggggccgucuucguggacgagaaccaguggaacuccgcgaaggaggccguggaggacgagcgguucugggaccugguccaccgcgagcgggagcuccacaagcagggcaagugcgccacgugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgccgacgacaccgccgggugggacacccgcaucaccgaggacgaccuccagaacgaggcgaagaucacggacaucauggagcccgagcacgcccugcuggccaccuccaucuucaagcucaccuaccagaacaaggucgugcgggugcagcgccccgccaagaacggcaccgucauggacgugaucagccggcgcgaccagcggggguccggccaggugggcacguacgggcugaacaccuucaccaacauggagguccagcugauccgccagauggagagcgagggcaucuuccuccccuccgagcuggagaccccgaaccuggccgagcgggcgcucgacuggcuggagaagcacggggccgagcgccugaagcggauggccaucagcggcgacgacugcguggugaagcccaucgacgaccgcuucgccacggcccucaccgcgcugaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcucguggggcgcgcccgggugucccagggcgccggguggagccugcgcgagaccgccugccugggcaaguccuacgcccagauguggcagcucauguacuuccaccggcgcgaccugcggcuggcggccaacgccaucugcagcgccguccccguggacugggugcccgcgagccgcaccaccugguccauccacgcccaccaccaguggaugacgaccgaggacaugcucagcgucuggaaccgcguguggaucgaggagaacccguggauggaggacaagacccacguguccagcugggaggagguccccuaccuggggaagcgggaggaccaguggugcggcucccugaucggccucaccgcccgcgccacgugggccaccaacauccagguggcgaucaaccaggugcggcgccugaucgggaacgagaacuaccuggacuacaugaccagcaugaagcgguucaagaacgaguccgaccccgagggcgcccucugguga

SEQ ID NO: 8873 - RNA, 9879 nt, Artificial Sequence
  derived and/or modified CDS sequence (opt1) from DENV-1__KC692513__SS-prME
agcgugaccaugcugcucaugcugcugcccaccgcccucgccuuccaccugaccacccggggcggggagccccacaugaucgugagcaagcaggagcggggcaagagccuccucuucaagaccuccgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcacccgggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcacgccccaggagaccuggaaccgccaggaccuccuggucacguucaagaccgcccacgccaagaagcaggagguggugguccugggcagccaggagggcgcgaugcacaccgcccucaccggggccacggagauccagaccuccggcaccaccacgaucuucgccgggcaccugaagugccggcugaagauggacaagcucacccugaagggcaugagcuacgugaugugcaccggguccuucaagcuggagaaggagguggccgagacccagcacggcacgguccugguccaggugaaguacgagggcaccgacgcgcccugcaagaucccguuccucacccaggacgagaagggggucacccagaacggccgccugaucacggccaaccccaucgugaccgacaaggagaagcccgugaacaucgagaccgagcccccguucggggagagcuacaucgucgugggcgccggcgagaaggcccugaagcucuccugguucaagaaggggagcuccaucggcaagauguucgaggcgaccgcccgcggggcccgccggauggccauccugggcgacacggccugggacuucgggagcaucggcggccuguucaccuccguggggaagcucauccaccaggucuucggcaccgcguacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagccccaagcggcuguccgccgcgaucggcaaggccugggaggagggggugugcggcauccgcagcgccacccggcuggagaacaucauguggaagcagaucagcaacgagcucaacuacauccugcuggagaacgacaugaaguucaccguggucgugggggacaucaacggcauccucgcccaggggaagaagaugauccgcccccagcccauggagcacaaguacuccuggaaguccuggggcaaggccaagaucaucggcgcggacauccagaacacgaccuucaucaucgacgggccggacacccccgagugccccgacgaccagcgggccuggaacaucugggagguggaggacuacggcuucgggaucuucaccacgaacaucuggcugaagcugcgcgacagccacacccagaugugcgaccaccggcucaugagcgccgccaucaaggacuccaaggcgguccacgccgacaugggcuacuggaucgagagcgagaagaacgagaccuggaagcuggcccgcgccuccuucaucgaggugaagaccugcaucuggcccaagagccacacgcugugguccaacggcgugcucgagagcgagauggucaucccgaagaucuacgggggccccaucucccagcacaacuaccggcccggguacuucacccagaccgccggcccguggcaccuggggaagcuggagcucgacuucgaccugugcgagggcaccacggugguggucgacgagcacugcggcuaccgcgggcccagccugcggaccaccaccgugacgggcaagaucauccacgaguggugcugccgcuccugcacccugccgccccugcgguuccgcggggaggacggcugcugguacgggauggagauccggccggugaaggagaaggaggagaaccugguccgcagcaugguguccgcgggcagcggcgagguggacuccuucagccucgggauccugugcgucagcauccugaucgaggaggugaugcggucccgcuggagccggaagaugcucaugaccggcacccuggccguguuccugcuccugaucauggggcagcugacguggaacgaccucauccgccugugcaucauggucggcgccaacgccuccgaccgcauggggaugggcaccaccuaccuggcccucauggcgaccuucaagaugcggcccauguucgccgugggccugcuguuccgccggcucacgagccgcgaggugcugcugcucaccgucgggcugucccugguggccagcgucgagcuccccaacucccuggaggagcugggcgacgggcucgccaugggcaucaugaugcugaagcugcucaccgacuuccagccccaccagcuguggaccacgcugcucagccugaccuucauccggaccucccugagccucgacuacgccuggaagaccauggcgauggcccuguccaucgugagccuguucccgcucugccuguccacgaccagccagaagaccaccuggcugcccgugcuccugggcuccuucgggugcaagccccugacgauguuccucaucaccgagaacaagaucuggggccgcaagagcuggcccaucaacgaggggaucauggccgucggcaucguguccauccugcugagcucccuccugaagaacgacgugccgcuggccgggccccucaucgcgggcggcaugcugaucgccugcuacgucaucagcgggagcuccgccgaccugagccucgagaaggccgccgagguguccugggaggaggaggcggagcacagcggcaccucccacaacauccugguggagguccaggacgacgggaccaugaagaucaaggacgaggagcgggacgacacccugacgauccuccugaaggccacccugcucgccgugagcggcguguaccccauguccauccccgccacccuguucgucugguacuucuggcagaagaagaagcagcgcagcggggugcugugggacaccccgagcccgcccgagguggagcgggccguccuggacgacggcaucuaccgcauccuccagcggggccugcuggggcgcagccaggugggcgugggggucuuccaggacggcguguuccacacgauguggcacgugacccgcggggcgguccucauguaccagggcaagcgccuggagcccuccugggccagcgugaagaaggaccugaucuccuacggcgggggcuggcgguuccaggggagcuggaacaccggcgaggaggugcaggucaucgccguggagccggggaagaaccccaagaacgugcagaccacgcccggcaccuucaagacccccgagggcgaggucggggccaucgcccucgacuucaagccgggcaccuccgggagccccaucgugaaccgcgagggcaagaucgugggccuguacgggaacggcgucgugacgaccuccgggaccuacgugagcgcgaucgcccaggccaaggccacccaggagggcccccugccggagaucgaggacgaggucuucaagaagcggaaccucacgaucauggaccugcaccccggguccggcaagacccgccgguaccugcccgccaucgugcgcgaggcgaucaagcggaagcuccgcacccugauccuggcccccacccgcguggucgccagcgagauggccgaggcgcucaagggcaugccgauccgguaccagacgaccgccgugaaguccgagcacaccgggcgcgagaucguggaccugaugugccacgccaccuucacgaugcggcugcucucccccguccgcgugcccaacuacaacaugaucaucauggacgaggcccacuucaccgaccccgccagcaucgcggcccggggcuacaucuccacccgcguggggaugggcgaggccgccgccaucuucaugaccgcgacgccgcccgggagcgucgaggccuucccccaguccaacgccgugauccaggacgaggagcgggacauccccgagcgcagcuggaacuccggcuacgacuggaucaccgacuucccgggcaagaccgugugguucguccccagcaucaaguccgggaacgacaucgccaacugccugcggaagaacggcaagcgcgugauccagcugagccggaagaccuucgacacggaguaccagaagaccaagaacaacgacugggacuacguggucaccaccgacaucuccgagaugggggccaacuuccgcgcggaccgggugaucgacccccgccggugccucaagcccgugauccugaaggagggcccggagcgcgucauccuggccgggcccaugcccgugacggucgccagcgccgcgcagcggcgcggccggaucggccgcaaccagaacaaggagggggaccaguacaucuacaugggccagccccucaacaacgacgaggaccacgcccacuggaccgaggccaagaugcugcuggacaacaucaacaccccggaggggaucauccccgcccucuucgagcccgagcgcgagaaguccgccgcgaucgacggcgaguaccggcugcgcggggaggcccggaagaccuucguggagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggacgaaggagggcgagcggaagaagcuccgcccgcgguggcuggacgcccgcaccuacuccgacccccuggcccuccgggaguucaaggaguucgcggccgggcgccggagcgucuccggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacaccaucgagacccugaugcugcucgcccugaucgccgugcugaccggcggggucacccucuucuuccugagcgggaaggggcugggcaagaccuccaucgggcuccugugcgugauggccagcuccgcgcugcucuggauggccagcguggagccgcacuggaucgccgccuccaucauccuggaguucuuccugaugguccuccugauccccgagcccgaccgccagcggaccccgcaggacaaccagcuggccuacguggugaucggccuccuguucaugauccugacggucgcggccaacgagauggggcuccuggagaccaccaagaaggaccugggcaucgggcacguggccguggagaaccaccaccacgccaccaugcucgacgucgaccugcgccccgccagcgcguggacgcuguacgccguggccaccaccgugaucacccccaugaugcggcacacgaucgagaacaccaccgccaacaucucccucaccgccaucgcgaaccaggccgccauccugaugggccuggacaagggcuggcccaucagcaagauggacaucggggucccgcuccuggcccugggcugcuacucccaggugaacccccucacgcugaccgccgcggugcugaugcucgucgcccacuacgccaucaucgggcccggccugcaggccaaggcgacccgcgaggcccagaagcgcaccgccgccgggaucaugaagaaccccacgguggacggcaucgugaccaucgaccuggacccggucguguacgacgccaaguucgagaagcagcucggccagaucaugcugcugauccucugcaccagccagauccugcugaugcggaccacgugggcgcucugcgaguccaucacccuggccaccgggccccugaccacgcucugggagggcagccccgggaaguucuggaacaccaccaucgccguguccauggccaacaucuuccgcggcagcuaccuggccggcgcggggcuggccuucucccucaugaagucccugggcgggggccggcgcgggaccggcgcccagggcgagacgcugggggagaaguggaagcggcagcucaaccagcuguccaagagcgaguucaacaccuacaagaaguccggcaucauggaggucgaccgcagcgaggccaaggaggggcugaagcggggcgagaccaccaagcacgccgugagccgcgggacggcgaagcugcggugguucguggagcgcaaccucgucaagcccgagggcaaggugaucgaccugggcugcgggcggggcgggugguccuacuacugcgccggccugaagaaggugaccgaggucaagggguacaccaagggcggcccggggcacgaggagcccauccccauggccaccuacggcuggaaccucgugaagcugcacagcgggaaggacguguucuucacgccgcccgagaagugcgacacgcugcucugcgacaucggcgaguccagccccaaccccaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccccugagccggaacuccacgcacgagauguacugggugagcugcggcaccgggaacaucgucuccgccgugaacaugaccagccgcaugcugcucaaccgguucaccauggcgcaccgcaagcccacguacgagcgcgacguggaccugggcgccggcacccggcacgucgccguggagccggagguggccaaccuggacaucaucgggcagcgcaucgagaacaucaagaacgagcacaaguccaccuggcacuacgacgaggacaaccccuacaagaccugggccuaccacggcagcuacgaggucaagcccuccgggagcgcguccagcauggugaacggcgucgugcggcuccugacgaagcccugggacgugaucccgauggucacccagaucgccaugaccgacaccacgcccuucgggcagcagcgcguguucaaggagaagguggacacccggacgccccgggccaagcggggcaccgcccagaucauggaggucacggccaaguggcuguggggcuuccucucccgcaacaagaagccgcggaucugcacccgcgaggaguucacccggaaggugcgcagcaacgcggccaucggggccguguucgucgacgagaaccaguggaacuccgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaagauccccggcggcaacauguacgccgacgacacggccgggugggacacccggaucaccgaggacgaccugcagaacgaggccaagaucaccgacaucauggagcccgagcacgcccuccuggcgacgagcaucuucaagcugaccuaccagaacaaggugguccgcgugcagcgccccgccaaguccggcaccgugauggacgucaucagccggcgcgaccagcggggguccggccaggugggcaccuacgggcucaacacguucaccaacauggaggugcagcugauccgccagauggagagcgagggcaucuucuccccgagcgagcuggagacccccaaccucgccaagaagguccuggacuggcuggagaagcacggggccgagcggcucaagcgcauggccaucuccggcgacgacugcguggugaagcccaucgacgaccgguucgcgaccgcccugacggcccugaacgacauggggaagguccgcaaggacaucccccagugggagccgagcaagggcuggaacgacuggcagcagguccccuucugcucccaccacuuccaccagcucaucaugaaggacggccgggagaucgugguccccugccgcaaccaggacgagcugguggggcgggcccgcgugagccagggcgccggguggucccugcgggagaccgcgugccucggcaagagcuacgcccagauguggcagcugauguacuuccaccgccgggaccugcgccucgccgccaacgccaucugcuccgcgguccccguggacugggugccgaccagccggaccaccuggagcauccacgcccaccaccaguggaugacgaccgaggacaugcuguccgucuggaaccgcguguggaucgaggagaaccccuggauggaggacaagacccacgugagcuccugggaggagguccccuaccuggggaagcgggaggaccaguggugcggcagccucaucggccugaccgcccgcgccacgugggcgaccaacauccagguggccaucaaccaggugcgccggcugaucggguccgagaacuaccucgacuacaugaccagcaugaagcgcuucaagaacgaguccgaccccgagggcgcccugugguga

SEQ ID NO: 8874 - RNA, 9879 nt, Artificial Sequence
  derived and/or modified CDS sequence (opt1) from DENV-1__KC692514__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacguucaagaugcgcccgauguucgccguggggcuccuguuccggcgccugaccagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgggacgacacccugaccauccuccugaaggccacccugcucgccguguccggggucuaccccaugagcauccccgcgacgcuguucgugugguacuucuggcagaagaagaagcagcgcuccggcgugcugugggacacccccagcccgcccgaggucgagcgggccgugcucgacgacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgcgagggcaagaucgucgggcuguacggcaacgggguggugaccaccagcggcacguacgucuccgccaucgcccaggccaagaccagccaggaggggccccugcccgagaucgaggacgagguguucaagaagcggaaccucaccaucauggaccugcacccgggcagcggcaagacccgccgguaccugcccgcgaucgugcgcgaggccaucaagcgcaagcuccggacgcugauccuggcccccacccgcgucguggccuccgagauggcggaggcccucaaggggaugcccauccgguaccagaccaccgccgucaagagcgagcacacgggccgcgagaucgucgaccugaugugccacgccaccuucaccaugcggcugcucuccccggugcgcgugcccaacuacaacaugaucaucauggacgaggcccacuucaccgaccccgcgagcaucgccgcccggggguacaucuccacgcgcgucggcaugggggaggccgccgcgaucuucaugaccgccacgccgcccggcagcguggaggccuucccccaguccaacgccgugauccaggacgaggagcgggacauccccgagcgcagcuggaacuccggcuacgacuggaucaccgacuuccccgggaagacggucugguucgugcccagcaucaaguccggcaacgacaucgccaacugccugcggaagaacgggaagcgcgugauccagcugagccggaagaccuucgacaccgaguaccagaagaccaagaacaacgacugggacuacgucgugacgaccgacaucuccgagaugggcgcgaacuuccgcgccgaccgggugaucgacccccgccggugccucaagcccgucauccugaaggacgggcccgagcgcgugauccuggccggcccgaugcccgucaccguggccagcgcggcccagcggcgcggccgcaucgggcggaaccagaacaaggagggcgaccaguacguguacauggggcagccccucaacaacgacgaggaccacgcccacuggaccgaggccaagaugcugcuggacaacaucaacacgcccgagggcaucaucccggcccucuucgagcccgagcgcgagaaguccgcggccaucgacggggaguaccggcugcgcggcgaggcccggaagaccuucgucgagcugaugcgccggggcgaccuccccguguggcugagcuacaagguggccuccgagggguuccaguacagcgaccgccgguggugcuucgacggcgagcgcaacaaccagguccuggaggagaacauggacguggagaucuggaccaaggagggggagcggaagaagcuccgcccccgguggcuggacgcccgcaccuacuccgacccgcuggcgcuccgggaguucaaggaguucgccgccggccgccggagcgugagcggcgaccugauccuggagaucgggaagcucccccagcaccugacccugcgcgcccagaacgcccucgacaaccuggucaugcugcacaacuccgagcagggcgggaaggcguaccggcacgccauggaggagcuccccgacacgaucgagacccugaugcugcucgcccugaucgccgugcugaccggcggggugacccucuucuuccugagcggcaagggccuggggaagacguccaucggccuccugugcgucaccgcgagcuccgcccugcucuggauggccagcguggagccccacuggaucgccgccuccaucauccuggaguucuuccugauggugcuccugaucccggagcccgaccgccagcggacgccccaggacaaccagcuggcguacgucgugaucgggcuccuguucaugauccugaccguggccgccaacgagaugggccuccuggagacgaccaagaaggaccuggggaucggcuacgucgccgccgagaaccaccagcacgcgaccaugcucgacguggaccugcacccggccagcgccuggacccuguacgccguggccacgaccgucaucacccccaugaugcgccacaccaucgagaacacgaccgcgaacaucucccucaccgccaucgccaaccaggccgccauccugaugggccuggacaagggguggcccaucagcaagauggacaucggcgugccccuccuggcgcuggggugcuacucccaggugaacccgcucacccugacggccgccguccugaugcucguggcccacuacgcgaucaucggccccgggcugcaggccaaggccacccgcgaggcccagaagcggaccgccgcgggcaucaugaagaaccccaccguggacggcaucgucgccaucgaccuggaccccgugguguacgacgccaaguucgagaagcagcucgggcagaucaugcugcugauccucugcacgagccagauccugcugaugcgcaccaccugggcccucugcgaguccaucacccuggccacgggcccgcugaccacccucugggaggggagccccggcaaguucuggaacaccacgaucgcggucuccauggccaacaucuuccggggcagcuaccuggccggggccggccuggccuucucccucaugaagucccucgggggcgggcgccgggggaccggcgcgcagggggagacccugggcgagaaguggaagcgccagcucaaccagcuguccaagagcgaguucaacaccuacaagcggagcgggaucauggagguggaccgcuccgaggccaaggagggccugaagcgcggggagacgaccaagcacgccgugagccgcggcaccgccaagcuccggugguucgucgagcgcaaccuggugaagcccgagggcaaggugaucgaccuggggugcggccgcgggggcugguccuacuacugcgcggggcugaagaaggucaccgaggugaagggcuacaccaagggcgggcccggccacgaggagccgauccccauggccacguacggguggaaccucgugaagcugcacagcggcaaggacgucuucuucaugccgcccgagaagugcgacacccugcucugcgacaucggggaguccagcccgaaccccaccaucgaggagggccgcacccugcgggugcugaagaugguggagcccuggcuccgcggcaaccaguucugcaucaagauccugaaccccuacaugccguccgucguggagacgcuggagcagaugcagcggaagcacgggggcaugcucgugcgcaacccccugagccggaacuccacccacgagauguacugggucagcugcgggaccggcaacaucguguccgccgugaacaugaccagccgcaugcugcucaaccgcuucacgauggcccaccggaagcccaccuacgagcgcgacgucgaccugggcgccgggacccggcacguggcgguggagcccgaggucgccaaccuggacaucaucggccagcgcaucgagaacaucaagaacgagcacaaguccaccuggcacuacgacgaggacaacccguacaagacgugggccuaccacgggagcuacgaggugaagcccuccggcagcgccuccagcauggucaacgggguggugcggcuccugaccaagcccugggacgucauccccauggugacccagaucgccaugaccgacacgaccccguucggccagcagcgcguguucaaggagaaggucgacacccggacgccccgggcgaagcggggcacgacccagaucauggaggugaccgccaaguggcuguggggguuccucucccgcaacaagaagccccggaucugcacccgcgaggaguucacgcggaaggugcgcagcaacgccgccaucggcgccgucuucguggacgagaaccaguggaacagcgcgaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaagggcucccgggcgaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgccgacgacaccgccggcugggacacccgcaucacggaggacgaccugcagaacgaggcgaagaucaccgacaucauggagcccgagcacgcccuccuggccaccagcaucuucaagcugaccuaccagaacaaggucgugcgggugcagcgccccgccaagaacgggacggucauggacgugaucucccggcgcgaccagcggggcagcggccagguggggaccuacggccucaacaccuucaccaacauggagguccagcugauccgccagauggaguccgaggggaucuuccugcccagcgagcucgagacgccgaaccuggccgagcgggcgcuggacuggcucgagaagcacggcgccgagcgccugaagcggauggccaucuccggggacgacugcguggugaagcccaucgacgaccgcuucgccaccgcccugaccgcgcucaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcccagauguggcagcugauguacuuccaccggcgcgaccuccggcuggcggccaacgccaucugcuccgccguccccguggacugggugcccgcgagccgcaccacguggagcauccacgcccaccaccaguggaugaccaccgaggacaugcuguccgucuggaaccgcguguggaucgaggagaacccguggauggaggacaagacccacgugagcuccugggaggagguccccuaccucggcaagcgggaggaccaguggugcggcagccugaucgggcugacggcccgcgccaccugggccaccaacauccagguggcgaucaaccaggugcggcgccucaucggcaacgagaacuaccuggacuacaugaccuccaugaagcgguucaagaacgagagcgaccccgagggggcccugugguga

SEQ ID NO: 8875 - RNA, 9879 nt, Artificial Sequence
  derived and/or modified CDS sequence (opt1) from DENV-1__KC692515__SS-prME
agcgugaccaugcugcucaugcugcugcccaccgcccucgccuuccaccugaccacccgcggcggggagccccacaugaucgugagcaagcaggagcggggcaagagccugcuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgggaaggcgcugaagcuguccugguucaagcgcggcagcuccaucgggaagauguucgaggccaccgcccggggcgcccgccgcauggccauccucggggacacggcgugggacuucggcagcaucggcgggguguucaccuccgugggcaagcugguccaccagguguucgggaccgccuacggcgugcuguucagcggggucuccuggaccaugaagaucggcaucggcauccuccugacguggcuggggcucaacagccgguccaccagccuguccaugaccugcaucgccgugggcauggugacccuguaccucggggucauggugcaggccgacagcggcugcgugaucaacuggaaggggcgcgagcugaagugcggcuccggcaucuucgucacgaacgaggugcacaccuggaccgagcaguacaaguuccaggccgacagcccgaagcggcugagcgcggccaucgggaaggccugggaggagggcgugugcgggauccgcuccgccacccggcucgagaacaucauguggaagcagaucagcaacgagcugaaccacauccugcucgagaacgacaugaaguucaccgucguggugggcgacgccaacgggauccuggcgcagggcaagaagaugauccgcccccagcccauggagcacaaguacuccuggaaguccuggggcaaggccaagaucaucggggccgacauccagaacacgaccuucaucaucgacggccccgacaccccggagugccccgacgggcagcgggccuggaacaucugggaggucgaggacuacggcuucggcguguucaccacgaacaucuggcugaagcuccgcgacuccuacacccagaugugcgaccaccggcugaugagcgcggccaucaaggacuccaaggccgugcacgccgacaugggguacuggaucgagagcgagaagaacgagaccuggaagcuggcccgcgcguccuucaucgaggucaagaccugcacguggcccaagagccacacccucugguccaacggcgugcuggagagcgagaugaucauccccaagaucuucgggggcccgaucucccagcacaacuaccggcccggguacuucacccagaccgccggccccuggcaccugggcaagcucgagcuggacuucgaccugugcgaggggacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacggcauggagauccggcccgucaaggagaaggaggagaaccucgugcgcagcaugguguccgccgggagcggcgaggucgacagcuucucccuggggauccugugcgugagcaucaugaucgaggaggugaugcggucccgcuggagccgcaagaugcucaugaccggcacgcuggccgucuuccugcuccugaucauggggcagcugaccuggaacgaccucauccggcugugcaucauggugggcgccaacgcguccgaccgcaugggcauggggaccaccuaccuggcccucauggccacguucaagaugcggccgauguucgccgugggccugcuguuccgccggcucaccagccgcgagguccugcugcucaccaucgggcugucccugguggccagcgucgagcuccccaacucccuggaggagcugggcgacggccucgcgauggggaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgucccccucgcgggcccgcugaucgccgggggcaugcugaucgccugcuacgugaucagcggguccagcgccgaccucucccuggagaaggccgcggaggugagcugggagcaggaggccgagcacuccggcgccagccacaacauccuggucgaggugcaggacgacgggacgaugaagaucaaggacgaggagcgcgacgacacccucaccauccugcugaaggccacccuccuggccguguccggcgucuaccccaugagcauccccgcgacgcuguucgugugguacuucuggcagaagaagaagcagcgguccggcgugcucugggacacccccagcccgcccgaggucgagcgcgccgugcuggacgacgggaucuaccggauccugcagcgcggccugcucgggcggucccaggugggcgucgggguguuccaggacggcguguuccacaccauguggcacgucacccgcggcgccgugcugauguaccaggggaagcggcuggagcccagcugggccuccgugaagaaggaccucaucagcuacggcgggggcuggcgcuuccagggguccuggaacacgggcgaggagguccaggugaucgccguggagcccggcaagaacccgaagaacguccagaccacccccgggaccuucaagacgcccgagggcgaggugggggcgaucgcccuggacuucaagcccggcaccagcggcuccccgaucgugaaccgggaggagaagaucgucgggcuguacggcaacgggguggugaccaccagcggcacguacgucuccgccaucgcccaggccaaggcgagccaggaggggccccuccccgagaucgaggacgagguguucaagaagcgcaaccugaccaucauggaccugcacccgggcagcggcaagacccggcgcuaccuccccgccaucgugcgggaggccaucaagcgcaagcugcgcacccugauccucgcccccacgcgggucguggcguccgagauggccgaggcccugaaggggaugcccauccgcuaccagaccaccgccgucaagagcgagcacaccggccgggagaucgucgaccugaugugccacgccacguucaccaugcgccuccuguccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcucagccgcaagacguucgacaccgaguaccagaagaccaagaacaacgacugggacuacgucgugaccacggacaucuccgagaugggcgccaacuuccgggccgaccgcgugaucgacccccggcgcugccugaagcccgucauccugaaggacgggcccgagcgggugauccucgccggcccgaugcccgucaccguggcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucgucgagcucaugcggcgcggcgaccugcccguguggcugagcuacaagguggccuccgagggguuccaguacagcgaccggcgcuggugcuucgacggcgagcggaacaaccagguccucgaggagaacauggacguggagaucuggaccaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggucaugcuccacaacuccgagcagggcgggaaggccuaccgccacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucgggcugcuguucaugauccucaccguggccgccaacgagaugggccugcuggagaccacgaagaaggaccucgggaucggccacgucgccgcggagaaccaccagcacagcaccaugcuggacguggaccugcacccggccuccgccuggacccucuacgccguggccaccacggucaucacccccaugaugcggcacaccaucgagaacaccacggcgaacaucagccugaccgccaucgccaaccaggccgccauccugaugggccucgacaagggguggcccaucuccaagauggacaucggcgugccccugcuggcgcucgggugcuacagccaggugaacccgcugacccugaccgccgccguccucaugcugguggcccacuacgcgaucaucggccccgggcugcaggccaaggccacgcgcgaggcccagaagcgcaccgccgcgggcaucaugaagaaccccaccguggacggcaucgucgccaucgaccucgaccccgugguguacgacgccaaguucgagaagcagcuggggcagaucaugcugcucauccugugcaccucccagauccugcucaugcggacgaccugggcccugugcgagagcaucacccuggccaccggcccgcucacgacccugugggaggggucccccggcaaguucuggaacaccaccaucgcggucagcauggccaacaucuuccgcggcuccuaccuggccggggccggccucgccuucagccugaugaagucccucgggggcgggcggcgcgggacgggcgcgcagggggagacccucggcgagaaguggaagcggcagcugaaccagcugagcaagagcgaguucaacaccuacaagcgcuccgggaucauggagguggaccggagcgaggccaaggagggccucaagcgcggggagaccacgaagcacgccgugucccggggcaccgccaagcugcgcugguucgucgagcggaaccuggugaagcccgagggcaaggugaucgaccuggggugcggccgcgggggcuggagcuacuacugcgcggggcucaagaaggucaccgaggugaagggcuacaccaagggcgggcccggccacgaggagccgauccccauggccaccuacggguggaaccuggugaagcugcacuccggcaaggacgucuucuucaugccgcccgagaagugcgacacgcuccugugcgacaucggggagagcuccccgaaccccaccaucgaggagggccggacccugcgcgugcucaagaugguggagcccuggcugcggggcaaccaguucugcaucaagauccugaaccccuacaugccgagcgucguggagacccucgagcagaugcagcgcaagcacgggggcaugcuggugcggaacccccugucccgcaacagcacgcacgagauguacugggucuccugcgggaccggcaacaucgugagcgccgugaacaugaccucccggaugcuccugaaccgcuucaccauggcccaccgcaagcccacguacgagcgggacgucgaccugggcgccgggacccgccacguggcgguggagcccgaggucgccaaccucgacaucaucggccagcggaucgagaacaucaagaacgagcaccgcagcaccuggcacuacgacgaggacaacccguacaagaccugggccuaccacggguccuacgaggugaagcccagcggcuccgccagcuccauggucaacgggguggugcggcugcugacgaagcccugggacgucauccccauggugacccagaucgccaugaccgacaccacgccguucggccagcagcgcguguucaaggagaaggucgacacccggacgccccgcgcgaagcggggcaccacgcagaucauggaggugaccgccaaguggcucuggggguuccugagccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcuccacaagcaggggaagugcgccacgugcguguacaacaugaugggcaagcgcgagaagaagcugggggaguucggcaaggccaagggcagccgggcgaucugguacauguggcugggggcccgcuuccucgaguucgaggcccugggcuucaugaacgaggaccacugguucucccgggagaacagccuguccgggguggagggcgaggggcuccacaagcugggcuacauccugcgcgacaucagcaagaucccgggcgggaacauguacgccgacgacaccgccggcugggacacccgcaucaccgaggacgaccuccagaacgaggcgaagaucacggacaucauggagcccgagcacgcccugcuggccaccuccaucuucaagcucaccuaccagaacaaggucgugcgggugcagcgccccgccaagaacgggaccgucauggacgugaucagccggcgcgaccagcggggcuccggccagguggggacguacggccugaacaccuucaccaacauggagguccagcugauccgccagauggagagcgaggggaucuuccuccccuccgagcuggagaccccgaaccuggccgagcgggcgcucgacuggcuggagaagcacggcgccgagcgccugaagcggauggccaucagcggggacgacugcguggugaagcccaucgacgaccgcuucgccacggcccucaccgcgcugaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcucgugggccgcgcccgggugucccagggggccggcuggagccugcgcgagaccgccugccuggggaaguccuacgcccagauguggcagcucauguacuuccaccggcgcgaccugcggcuggcggccaacgccaucugcagcgccguccccguggacugggugcccgcgagccgcaccaccugguccauccacgcccaccaccaguggaugacgaccgaggacaugcucagcgucuggaaccgcguguggaucgaggagaacccguggauggaggacaagacccacguguccagcugggaggagguccccuaccugggcaagcgggaggaccaguggugcggcucccugaucgggcucaccgcccgcgccacgugggccaccaacauccagguggcgaucaaccaggugcggcgccugaucggcaacgagaacuaccuggacuacaugaccagcaugaagcgguucaagaacgaguccgaccccgagggggcccucugguga

SEQ ID NO: 8876 - RNA, 9879 nt, Artificial Sequence
  derived and/or modified CDS sequence (opt1) from DENV-1__KC692516__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcaucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacaacuucagccucggcauccugugcgucuccaucaugaucgaggaggugaugcggagccgcuggucccgcaagaugcugaugaccgggacgcucgccguguuccugcugcucaucaugggccagcugaccuggaacgaccugauccggcucugcaucauggucggggccaacgcgagcgaccgcaugggcaugggcaccaccuaccuggcccugauggccacguucaagaugcggccgauguucgccguggggcuccuguuccgccggcugaccucccgcgaggugcuccugcugaccaucggccucagccuggucgccucccuggagcuccccaacagccuggaggagcugggggacggccucgcgaugggcaucaugaugcugaagcugcucaccgaguuccagccccaccagcuguggacgacccugcucucccugaccuucgugaagaccacgcugagccucgacuacgccuggaagaccaccgccaugguccuguccaucgugagccuguucccccucugccuguccaccacgagccagaagaccaccuggcugccggugcuccugggguccuucggcugcaagccccugaccauguuccucaucaccgagaacaagaucugggggcgcaagagcuggccccugaacgagggcaucauggccaucgggaucgucuccauccugcucagcucccugcugaagaacgacgugccccucgcgggcccgcugaucgccggcgggaugcugaucgccugcuacgugaucagcggcagcuccgccgaccucagccuggagaaggccgcggaggucuccugggagcaggaggccgagcacagcggggccucccacaacauccugguggaggugcaggacgacggcacgaugaagaucaaggacgaggagcgcgacgacacccucaccauccugcugaaggccacccuccuggccgucagcgggguguaccccauguccauccccgcgacgcuguucgugugguacuucuggcagaagaagaagcagcggagcggcguccucugggacacccccuccccgcccgagguggagcgcgccgugcuggacgacggcaucuaccggauccugcagcgcgggcugcucggccggagccaggucggggugggcguguuccaggacggggucuuccacaccauguggcacgugacccgcggcgccgugcugauguaccagggcaagcggcuggagcccuccugggccugcgucaagaaggaccucaucagcuacgggggcggguggcgcuuccagggccuguggaacacgggggaggagguccaggugaucgccgucgagcccggcaagaacccgaagaacgugcagaccacccccggcaccuucaagacgcccgagggggaggugggcgcgaucgcccuggacuucaagcccgggaccuccggcagcccgaucgucaaccgggagggcaagaucguggggcucuacggcaacgggguggucaccaccuccggcacguacgugagcgccaucgcccaggccaaggcgucccaggaggggccccugcccgagaucgaggacgagguguucaagaagcgcaaccugaccaucauggaccuccacccgggcagcggcaagacccggcgcuaccugcccgccaucguccgggaggccaucaagcgcaagcugcgcacccucauccuggcccccacgcgggugguggcguccgagauggccgaggcccugaaggggaugcccauccgcuaccagaccaccgccgucaagagcgagcacaccggccgggagaucguggaccucaugugccacgccacguucaccaugcgccugcugagcccggugcggguccccaacuacaacaugaucaucauggacgaggcgcacuucaccgaccccgccuccaucgccgcccgcggguacaucagcacccgggugggcaugggggaggccgcggccaucuucaugacggccacgccgcccggcuccguggaggccuucccccagagcaacgccgucauccaggacgaggagcgcgacauccccgagcgguccuggaacagcggcuacgacuggaucaccgacuuccccgggaagaccgugugguucgugcccuccaucaagagcggcaacgacaucgcgaacugccuccgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccugaagcccgugauccucaaggacgggcccgagcgggugauccuggccggcccgaugcccgucaccguggcguccgccgcccagcgccggggccgcaucgggcgcaaccagaacaaggagggcgaccaguacgucuacauggggcagccccugaacaacgacgaggaccacgcccacuggaccgaggccaagaugcuccuggacaacaucaacacccccgagggcaucaucccggcgcuguucgagcccgagcgggagaaguccgccgccaucgacggggaguaccgccuccggggcgaggcccgcaagacguucguggagcugaugcggcgcggcgaccugcccguguggcucuccuacaaggucgccagcgagggguuccaguacuccgaccggcgcuggugcuucgacggcgagcggaacaaccaggugcuggaggagaacauggacguggagaucuggaccaaggagggggagcgcaagaagcugcggccccgcuggcucgacgcgcggaccuacagcgacccgcuggcccugcgcgaguucaaggaguucgccgccggccggcgcuccgucagcggcgaccucauccuggagaucgggaagcugccccagcaccucacccugcgggcccagaacgcgcuggacaaccucgugaugcugcacaacuccgagcagggcgggaaggccuaccgccacgccauggaggagcugcccgacaccaucgagacgcucaugcugcuggcccucaucgcggugcugaccggcggggucacccuguucuuccucagcggcaagggccuggggaagaccagcaucggccugcucugcgugacggccuccagcgcccugcuguggauggccuccguggagccccacuggaucgccgcgagcaucauccucgaguucuuccugaugguccugcucaucccggagcccgaccggcagcgcacgccccaggacaaccagcuggccuacguggugaucgggcuccucuucaugauccugaccgucgccgccaacgagaugggccugcucgagaccacgaagaaggaccuggggaucggccacguggccgcggagaaccaccagcacgccaccaugcuggacguggaccuccacccggccuccgccuggacccuguacgccgucgcgaccacggugaucacccccaugaugcggcacaccaucgagaacaccacggccaacaucagccugaccgccaucgccaaccaggccgcgauccucaugggccuggacaagggguggcccaucuccaagauggacaucggcgugccccugcucgcccuggggugcuacagccaggucaacccgcugacccucaccgccgccgugcugaugcugguggcgcacuacgccaucaucggccccgggcuccaggccaaggccacgcgcgaggcccagaagcgcaccgcggccggcaucaugaagaaccccaccgucgacggcaucguggccaucgaccuggaccccguggucuacgacgccaaguucgagaagcagcuggggcagaucaugcuccugauccugugcaccucccagauccuccugaugcggacgaccugggcccugugcgagagcaucacccucgcgaccggcccgcugacgacccugugggaggggucccccggcaaguucuggaacaccaccaucgccgugagcauggccaacaucuuccgcggcuccuaccucgccggggccggccuggcguucagccugaugaagucccucgggggcgggcggcgcggcacgggcgcccagggggagacccugggcgagaaguggaagcggcagcugaaccagcucagcaaguccgaguucaacaccuacaagcgcagcgggaucauggagguggaccgguccgaggccaaggagggccugaagcgcggggagaccacgaagcacgccgucagccggggcaccgcgaagcugcgcugguucguggagcggaaccuggugaagcccgagggcaaggucaucgaccucgggugcggccgcgggggcuggagcuacuacugcgccgggcugaagaaggugaccgaggugaagggcuacaccaagggcgggcccggccacgaggagccgauccccauggccaccuacggguggaaccuggucaagcuccacuccggcaaggacguguucuucaugccgcccgagaagugcgacacgcugcugugcgacaucggggagagcuccccgaaccccaccaucgaggagggccggacccuccgcgugcugaagauggucgagcccuggcugcggggcaaccaguucugcaucaagauccucaaccccuacaugccgagcgugguggagacccuggagcagaugcagcgcaagcacgggggcaugcugguccggaacccccucucccgcaacagcacgcacgagauguacugggugucccgggggaccggcaacaucgugagcgccgucaacaugaccucccgcaugcugcugaaccgcuucaccauggcccaccggaagcccacguacgagcgcgacguggaccucggcgcggggacccggcacguggccgucgagcccgagguggccaaccuggacaucaucggccagcgcaucgagaacaucaagaacgagcacaagagcaccuggcacuacgacgaggacaacccguacaagaccugggccuaccacggguccuacgaggugaagcccagcggcuccgccagcuccauggucaacggggugguccggcugcucacgaagcccugggacgugauccccauggugacccagaucgcgaugaccgacaccacgccguucggccagcagcgcgucuucaaggagaagguggacacccggacgccccgggccaagcggggcaccacgcagaucauggaggugaccgccaaguggcuguggggguuccugagccgcaacaagaagccccggaucugcacccgcgaggaguucacccggaagguccgcuccaacgccgccaucggcgcgguguucguggacgagaagcaguggaacagcgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggcgaagggcucccgggccaucugguacauguggcucggggcccgcuuccuggaguucgaggcccugggcuucaugaacgaggaccacugguucagccgggagaacagccucuccggggucgagggcgaggggcugcacaagcugggcuacauccuccgcgacaucagcaagaucccgggcgggaacauguacgccgacgacaccgcgggcugggacacccgcaucaccgaggacgaccugcagaacgaggccaagaucacggacaucauggagcccgagcacgcccugcucgccaccuccaucuucaagcugaccuaccagaacaagguggugcggguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuuccugcccuccgagcuggagaccccgaaccucgcggagcgggugcuggacuggcuggagaagcacggcgccgagcgccucaagcggauggccaucagcggggacgacugcgucgugaagcccaucgacgaccgcuucgccacggcccugaccgcgcugaacgacaugggcaaggugcggaaggacaucccccagugggagcccuccaagggcuggaacgacuggcagcaggucccguucugcagccaccacuuccaccagcucaucaugaaggacgggcgcgagaucguggugcccugccggaaccaggacgagcuggucggccgcgcccgggugucccagggggccggcuggagccugcgcgagaccgccugccucgggaaguccuacgcccagauguggcagcugauguacuuccaccggcgcgaccugcggcucgcggccaacgccaucugcagcgccgugcccgucgacugggugcccaccucccgcaccacguggagcauccacgcgcaccaccaguggaugaccaccgaggacaugcuguccguguggaaccgcgucuggaucgaggagaacccguggauggaggacaagacccacgugagcagcugggaggaggugcccuaccugggcaagcgggaggaccaguggugcggcucccucaucgggcugacggcccgcgccaccugggccaccaacauccaggucgccaucaaccaggugcggcgccugaucggcaacgagaacuaccucgacuacaugaccagcaugaagcgguucaagaacgaguccgaccccgagggggcgcugugguga

SEQ ID NO: 8877 - RNA, 9879 nt, Artificial Sequence
  derived and/or modified CDS sequence (opt1) from DENV-1__KC692517__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaucgagcacggcaccaucgcgaccaucacgccccaggcccccaccagcgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcacgccccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcugguccaggugaaguacgagggcacggacgcccccugcaagaucccguucagcacccaggacgagaagggggugacccagaacggccggcucaucaccgccaaccccaucgucacggacaaggagaaguccgugaacaucgagaccgagccgcccuucggggagagcuacaucguggucggcgugggcgagaaggcccugaagcuguccugguucaagaaggggagcuccaucggcaagauguucgaggcgaccgcccgcggggcccggcgcauggccauccucggcgacaccgccugggacuucgggagcaucggcggcguguucacguccgucgggaagcuggugcaccagguguucggcaccgcguacgggguccuguucagcggcguguccuggaccaugaagaucgggaucggcauccuccugaccuggcugggccucaacagccgcuccacgagccuguccaugaccugcaucgccguggggauggucacccuguaccucggcgugauggugcaggccgacagcgggugcgucaucaacuggaagggccgggagcugaagugcggguccggcaucuucgugaccaacgaggugcacacguggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccuggcccaggggaagaagaugauccggccccagcccauggagcacaaguacuccuggaaguccuggggcaaggcgaagaucaucggcgccgacauccagaacaccacguucaucaucgacgggcccgacaccccggagugccccgacggccagcgcgccuggaacaucugggagguggaggacuacggguucggcaucuucaccaccaacaucuggcugaagcuccgggacuccuacacgcagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagaccugcaccuggcccaagagccacacgcucugguccaacggggugcuggagagcgagaugaucauccccaagaucuacggcgggccgaucucccagcacaacuaccgccccggcuacuucacccagaccgcggggcccuggcaccugggcaagcucgagcuggacuucgaccugugcgagggcaccacgguggucguggacgagcacugcgggaaccggggcccgagccuccgcaccaccaccgugacggggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugaccgggacccuggccgucuuccugcuccugaucaugggccagcugacguggaacgaccucauccgccugugcaucauggugggggccaacgccuccgaccggaugggcaugggcaccaccuaccuggcgcucauggccaccuucaagaugcgcccgauguucgccguggggcugcuguuccggcgccucacgagccgggagguccugcugcucaccaucgggcugucccugguggccagcgucgagcuccccaacucccuggaggagcugggggacggccucgccaugggcaucaugaugcugaagcugcucaccgaguuccagccccaccagcuguggaccacgcugcucagccugaccuucgugaagaccacccugucccucgacuacgcguggaagacgaccgccauggugcugagcaucgucucccuguucccccucugccugagcaccaccucccagaagacgaccuggcugccggugcuccuggggagcuucggcugcaacccccugaccauguuccucaucaccgagaacaagaucugggggcgcaaguccuggccccugaacgagggcaucauggccaucgggaucgugagcauccugcucuccagccugcugaagaacgacgucccccucgccggcccgcugaucgcgggcgggaugcugaucgccugcuacgugaucagcggcuccagcgccgaccucucccuggagaaggccgccgaggugagcugggagcaggaggcggagcacuccggggccagccacaacauccuggucgaggugcaggacgacggcaccaugaagaucaaggacgaggagcgggacgacacgcucaccauccugcugaaggccacccuccuggccguguccggggucuaccccaugagcauccccgccacccuguucgugugguacuucuggcagaagaagaagcagcgcuccggcgugcucugggacacgcccagcccgcccaaggucgagcgggcggugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacaccggggaggagguccaggugaucgccguggagcccggcaagaacccgaagaacguccagacgacccccggcaccuucaagacccccgagggggaggugggcgccaucgcgcuggacuucaagcccgggacgagcggcuccccgaucgugaaccgcgagggcaagaucgucgggcuguacggcaacgggguggugaccaccagcggcaccuacgucuccgccaucgcccaggccaaggccagccaggaggggccccuccccgagaucgaggacgagguguucaagaagcggaaccugacgaucauggaccugcacccgggcagcggcaagacccgccgguaccuccccgcgaucgugcgcgaggccaucaagcggaagcugcgcacccugauccucgcccccacccgcgucguggccuccgagauggcggaggcccugaaggggaugcccauccgguaccagacgaccgccgucaagagcgagcacaccggccgcgagaucgucgaccugaugugccacgccaccuucacgaugcggcuccuguccccggugcgcgugcccaacuacaacaugaucaucauggacgaggcccacuucaccgaccccgcgagcaucgccgcccggggguacaucuccacccgcgucggcaugggggaggccgccgcgaucuucaugaccgccacgcccccgggcagcguggaggccuucccccaguccaacgccgugauccaggacgaggagcgggacauccccgagcgcagcuggaacuccggcuacgacuggaucaccgacuuccccgggaagaccgucugguucgugccgagcaucaaguccggcaacgacaucgccaacugccugcggaagaacgggaagcgcgugauccagcucagccggaagaccuucgacacggaguaccagaagaccaagaacaacgacugggacuacgucgugaccaccgacaucuccgagaugggcgcgaacuuccgcgccgaccgggugaucgacccccgccggugccugaagcccgucauccugaaggacgggcccgagcgcgugauccucgccggcccgaugcccgucacgguggccagcgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcccuguucgagcccgagcgcgagaaguccgcggccaucgacggggaguaccggcugcgcggcgaggcccggaagaccuucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccgcucgcgcugcgggaguucaaggaguucgccgccggccgccggagcgugagcggcgaccugauccucgagaucgggaagcugccccagcaccugacccuccgcgcccagaacgcccuggacaaccuggucaugcuccacaacuccgagcagggcgggaaggcguaccggcacgccauggaggagcugcccgacaccaucgagacccugaugcuccuggcccugaucgccgugcucacgggcggggugacccuguucuuccugagcggcaagggccucgggaagaccuccaucggccugcugugcgucaccgcgagcuccgcccuccuguggauggccagcguggagccccacuggaucgccgccuccaucauccuggaguucuuccucauggugcugcugaucccggagcccgaccgccagcggacgccccaggacaaccagcucgcguacgucgugaucgggcugcuguucaugauccucaccguggccgccaacgagaugggccugcuggagaccaccaagaaggaccucgggaucggcuacgucgccgccgagaaccaccagcacgcgacgaugcuggacguggaccugcgcccggccagcgccuggacccucuacgccguggccaccaccgucaucacgcccaugaugcggcacaccaucgagaacaccaccgcgaacaucucccugacggccaucgccaaccaggccgccauccugaugggccucgacaagggguggcccaucagcaagauggacaucggcgugccccugcuggcgcucgggugcuacucccaggugaacccgcugacccugaccgccgccguccucaugcugguggcccacuacgcgaucaucggccccgggcugcaggccaaggccacccgcgaggcccagaagcgcacggccgcgggcaucaugaagaaccccaccguggacggcaucgucgccaucgaccucgaccccgugguguacgacgccaaguucgagaagcagcuggggcagaucaugcugcucauccugugcaccagccagauccugcucaugcggaccacgugggcccugugcgaguccaucacccuggccaccggcccgcucaccacgcugugggaggggagccccggcaaguucuggaacaccaccaucgcggucuccauggccaacaucuuccgcggcagcuaccuggccggggccggccucgccuucucccugaugaagucccucgggggcgggcggcgcgggaccggcgcgcagggggagacgcucggcgagaaguggaagcggcagcugaaccagcuguccaagagcgaguucaacaccuacaagcgcagcgggaucauggagguggaccgguccgaggccaaggagggccucaagcgcggggagaccaccaagcacgccgugagccggggcacggccaagcugcgcugguucgucgagcggaaccuggugaagcccgagggcaaggugaucgaccuggggugcggccgcgggggcugguccuacuacugcgcggggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacccuccugugcgacaucggggaguccagcccgaaccccacgaucgaggagggccggacccugcgcgugcucaagaugguggagcccuggcugcggggcaaccaguucugcaucaagauccugaaccccuacaugccguccgucguggagacccucgagcagaugcagcgcaagcacgggggcaugcuggugcggaacccccugagccgcaacuccacccacgagauguacugggucagcugcgggacgggcaacaucguguccgccgugaacaugaccagccggaugcuccugaaccgcuucaccauggcccaccgcaagcccaccuacgagcgggacgucgaccugggcgccgggacgcgccacguggcgguggagcccgaggucgccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccugcugaccaagcccugggacgucauccccauggugacgcagaucgccaugaccgacaccaccccguucggccagcagcggguguucaaggagaaggucgacacgcgcacgccccgggcgaagcgcggcaccacccagaucauggaggugacggccaaguggcucuggggguuccugucccggaacaagaagccccgcaucugcacccgggaggaguucacccgcaaggugcggagcaacgccgccaucggcgccgucuucguggacgagaaccaguggaacagcgcgaaggaggccguggaggacgagcgcuucugggaccugguccaccgggagcgcgagcuccacaagcaggggaagugcgcgaccugcguguacaacaugaugggcaagcgggagaagaagcugggggaguucggcaaggccaagggcucccgcgcgaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacacggccggcugggacacccgcaucaccgaggacgaccuccagaacgaggcgaagaucaccgacaucauggagcccgagcacgcccugcuggccacgagcaucuucaagcucaccuaccagaacaaggucgugcgcgugcagcggcccgccaagaacgggaccgucauggacgugaucucccgccgggaccagcgcggcagcggccagguggggaccuacggccugaacacguucaccaacauggagguccagcuggugcggcagauggaguccgaggggaucuuccuccccagcgagcuggagaccccgaaccuggccgagcgcgugcucgacuggcuggagaagcacggcgucgagcggcugaagcgcauggcgaucuccggggacgacugcguggugaagcccaucgacgaccgguucgccaccgcccucacggcccugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggcgggcuggucccugcgggagaccgccugccugggcaagagcuacgcccagauguggcagcucauguacuuccaccgccgggaccugcgccuggccgccaacgcgaucugcuccgccguccccguggacugggugcccaccagccggaccaccuggagcauccacgcccaccaccaguggaugacgaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucaccgcccgggcgacgugggccaccaacauccagguggccaucaaccaggugcgccggcugaucggcaacgagaacuaccuggacuacaugaccuccaugaagcgcuucaagaacgagagcgaccccgagggggcccucugguga

SEQ ID NO: 8878 - RNA, 9879 nt, Artificial Sequence
  derived and/or modified CDS sequence (opt1) from DENV-1__KC762649__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacacccucaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcgccagcaucacccagaaggggaucaucuucauccugcugaugcucgugacccccuccauggccaugcggugcgucggcaucggcagccgcgacuucguggaggggcuguccggcgccaccuggguggacgucgugcuggagcacgggagcugcgugacgaccauggcgaaggacaagcccacccucgacaucgagcugcugaagaccgaggucacgaaccccgccgugcuccggaagcugugcaucgaggccaagaucuccaacaccaccaccgacagccgcugcccgacgcagggcgaggccacccugguggaggagcaggacgccaacuucgucugccggcgcaccuucguggaccggggcugggggaacggcugcgggcuguucggcaaggggucccugaucacgugcgcgaaguucaagugcgugagcaagcuggagggcaagaucguccaguacgagaaccucaaguacuccgugaucgugacgguccacaccggcgaccagcaccagguggggaacgagagcaccgagcacggcaccacggccaccaucacgccccaggcccccaccaccgagauccagcugacggacuacggggcccugacccucgacugcagcccccggaccggccuggacuucaacgagaugguccugcucaccaugaaggagaaguccuggcuggugcacaagcagugguuccuggaccucccccugcccuggacgagcggggccuccaccagccaggagaccuggaaccggcaggaccugcucgugaccuucaagacggcgcacgccaagaagcaggaggucguggugcugggcucccaggagggcgccaugcacaccgcccugaccggggccaccgagauccagacgagcggcaccaccaccaucuucgcggggcaccucaagugccgccugaagauggacaagcugacgcucaagggcauguccuacgucaugugcaccgggagcuucaagcuggagaaggagguggccgagacccagcacggcaccgugcugguccagaucaaguacgagggcacggacgcccccugcaagauccccuucuccacccaggacgagaagggggugacccagaacggccggcugaucaccgccaacccgaucgugacggacaaggagaagcccgucaacaucgaggcggagccgcccuucggggagagcuacaucgugaucggcgccggcgagaaggcccucaagcuguccugguucaagaaggggagcuccaucggcaagauguucgaggccaccgcccgcggggcgcggcgcauggccauccugggcgacaccgccugggacuucgggagcaucggcggcguguucaccuccgucgggaagcucgugcaccagaucuucggcacggccuacggggugcuguucagcggcgucuccuggaccaugaagaucgggaucggcgugcugcucaccuggcugggccugaacagccgcuccaccagccucuccaugacgugcaucgccguggggcuggucacccuguaccucggcgugauggugcaggcggacagcgggugcgucaucaacuggaagggccgggagcugaagugcgggagcggcaucuucgugaccaacgaggugcacaccuggacggagcaguacaaguuccaggccgacuccccgaagcgccugagcgccgccaucggcaaggccugggaggagggggucugcggcauccgguccgcgacccgccucgagaacaucauguggaagcagaucagcaacgagcugaaccacauccugcucgagaacgacaugaaguucaccgugguggucggggacguggccggcauccuggcccaggggaagaagaugauccggccccagcccauggagcacaaguacuccuggaaguccuggggcaaggccaagaucaucggcgcggacgugcagaacaccaccuucaucaucgacgggcccaacacgccggagugccccgacgaccagcgcgccuggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgcggacaugggcuacuggaucgagagcgagaagaacgagacguggaagcuggcccgggccuccuucaucgaggucaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccguggucguggacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgucaagagcauggugagcgccggcuccggcgaggucgacagcuucucccuggggcugcucugcaucagcaucaugaucgaggaggugaugcggucccgcuggagccggaagaugcugaugacgggcacccuggcgguguucuuccuccugaucauggggcagcugaccuggaacgaccucauccgccugugcaucauggucggcgccaacgccuccgaccgcauggggaugggcaccacguaccuggcccucauggccaccuucaagaugcggccgauguucgcggugggccugcuguuccgccggcucaccagccgcgaggugcugcugcucaccaucgggcugucccuggucgccagcguggagcuccccaacucccuggaggagcugggcgacgggcucgccaugggcaucaugauccugaagcugcucacggacuuccagagccaccagcugugggccacccugcucucccugaccuucaucaagaccacguucagccugcacuacgcguggaagaccauggccaugguccucuccaucgugagccuguucccccugugccucuccaccaccagccagaagacgaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgcgggcggcaugcugaucgccugcuacgucaucuccgggagcuccgccgaccucagccuggagaaggccgccgagguguccugggaggaggaggcggagcacagcggcgccucccacaacauccugguggagguccaggacgacgggaccaugaagaucaaggacgaggagcgcgacgacacgcucaccauccugcugaaggccacccuccuggccgugagcggcguguacccgcuguccauccccgccacccucuucgucugguacuucuggcagaagaagaagcagcggagcggggugcugugggacacccccagcccgcccgagguggagcgcgcgguccuggacgacggcaucuaccggaucaugcagcgcggccugcucgggcggagccaggugggcgugggggucuuccaggagaacguguuccacacgauguggcacgugacccgcggcgccguccugauguaccaggggaagcggcuggagcccuccugggccagcgugaagaaggaccucaucuccuacggcggcggguggcgccugcagggcagcuggaacaccggggaggaggugcaggucaucgccguggagcccggcaagaaccccaagaacgugcagaccgcccccgggaucuucaagacgcccgagggcgaggucggcgcgaucgcccuggacuucaagcccgggaccuccggcagccccaucgugaaccgggaggggaagaucgugggccucuacggcaacggggucgugaccaccagcggcacguacguguccgccaucgcccaggcgaaggccagccaggaggggccgcugcccgagaucgaggacgaggucuuccgcaagcggaaccugaccaucauggaccuccaccccggcuccgggaagacccgccgguaccugccggccaucgugcgcgaggccaucaagcggaagcugcgcacccucauccuggcccccacgcgcguggucgcgagcgagauggccgaggcccugaagggcaugcccauccgguaccagaccaccgccgugaaguccgagcacaccggcaaggagaucguggaccucaugugccacgccacguucaccaugcgccugcugagccccguccgggugccgaacuacaacaugaucaucauggacgaggcgcacuucaccgaccccuccagcaucgccgcccgcggguacaucuccacccgggugggcaugggggaggccgccgcgaucuucaugacggccacgccgcccggcagcgucgaggccuucccgcaguccaacgccgugauccaggacgaggagcgcgacauccccgagcggagcuggaacuccggguacgaguggaucaccgacuuccccggcaagaccgugugguucguccccagcaucaaguccggcaacgacaucgcgaacugccuccgcaagaacgggaagcgggugauccagcugagccgcaagacguucgacaccgaguaccagaagaccaagaacaacgacugggacuacguggucaccacggacaucuccgagaugggcgccaacuuccgggccgaccgcgugaucgacccgcggcgcugccugaagcccgugauccucaaggacgggcccgagcgggucauccuggccggccccaugccggugaccgucgccagcgcggcccagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgcggccaucgacggggaguaccgccuccggggcgaggcccgcaagacguucguggagcugaugcggcgcggggaccugcccgucuggcucagcuacaagguggccagcgagggcuuccaguacuccgaccggcgcuggugcuucgacggcgagcggaacaaccaggugcuggaggagaacauggacgucgagaucuggaccaaggagggggagcgcaagaagcugcggccccgcuggcucgacgcccggaccuacagcgacccccuggcgcugcgcgaguucaaggaguucgccgccggccggcgcuccgugagcggggaccucauccuggagaucggcaagcugccgcagcaccucacccagcgggcccagaacgcgcuggacaaccuggugaugcuccacaacuccgagcagggcgggcgcgccuaccggcacgccauggaggagcugcccgacacgaucgagacccugaugcuccuggcccugaucgccguccucaccggcggggugacccuguucuuccugagcggccgcgggcucggcaagacguccaucggccugcugugcgugauggcgagcuccguccuccuguggauggccagcguggagccccacuggaucgccgccuccaucauccuggaguucuuccucauggugcugcugauccccgagccggaccggcagcgcacgccccaggacaaccagcucgccuacgucgugaucgggcugcuguucaugauccucaccguggcggccaacgagaugggccugcuggagaccaccaagaaggaccucgggaucggccacgucgccguggagaaccaccaccacgccgccaugcuggacguggaccugcaccccgcgagcgccuggacgcucuacgccgucgccaccaccaucaucaccccgaugaugcggcacacgaucgagaacaccaccgccaacaucucccugaccgcgaucgccaaccaggccgccauccugauggggcucgacaagggcuggcccaucagcaagauggacaucggcgugccccugcuggcgcucgggugcuacucccaggugaacccccugacgcugaccgccgccguccucaugcugguggcccacuacgccaucaucggcccggggcugcaggcgaaggccacccgcgaggcccagaagcgcaccgccgccggcaucaugaagaaccccacgguggacgggaucgucgcgaucgaccucgaccccgugguguacgacgccaaguucgagaagcagcugggccagaucaugcugcucauccugugcaccagccagauccugcucaugcggaccaccugggcccugugcgaguccaucacgcuggccaccggcccccucaccacccugugggaggggagcccgggcaaguucuggaacacgaccaucgccgucuccauggcgaacaucuuccgcgggagcuaccuggccggcgccggccucgccuucagccugaugaagucccucgggggcgggcggcgcgggaccggggcgcagggcgagacccucggcgagaaguggaagcggcagcugaaccagcugagcaaguccgaguucaacacguacaagcgcagcgggaucauggagguggaccgguccgaggccaaggagggccucaagcgcggggagaccaccaagcacgccgugagccggggcaccgccaagcugcgcugguucgucgagcggaaccuggugaagcccgaggggaaggugaucgaccugggcugcggccgcgggggcugguccuacuacugcgccgggcucaagaaggucacggaggugaagggcuacaccaagggcggccccggccacgaggagcccaucccgauggcgaccuacggguggaaccuggugaagcugcacagcggcaaggacgucuucuucaucccgcccgagaagugcgacacccuccugugcgacaucggggaguccagccccaacccgacgaucgaggagggccggacccugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggacgggcaacaucguguccgccgugaacaugaccagccggaugcuccugaaccgcuucaccauggcccaccgcaagcccaccuacgagcgggacgucgaccugggggccggcacccgccacguggccguggagcccgaggucgcgaaccucgacaucaucggccagcggaucgagaacaucaagcacgagcacaaguccacguggcacuacgacgaggacaaccccuacaagaccugggccuaccacgggagcuacgaggugaagccguccggcagcgccagcuccauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcgcgguggcucuggggcuuccugagccgcaacaagaagccccggaucugcacgcgcgaggaguucacccggaaggugcgcuccaacgccgccaucggcgccgucuucguggacgagaaccaguggaacagcgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacgcggaucaccgaggacgaccuccagaacgaggccaagaucaccgacaucauggagccggagcacgcgcugcuggccaaggccaucuucaagcucaccuaccagaacaaggucgugcgcgugcagcgccccgccaagaacgggacggucauggacgugaucagccggcgcgaccagcggggcuccggccagguggggaccuacggccugaacaccuucaccaacauggaggcccagcugauccgccagauggagagcgaggggaucuucucccccagcgagcucgagacgcccaaccuggcggagcggguccuggacuggcucgagaaguacggcguggagcgccugaagcggauggccaucuccggggacgacugcguggucaagccgaucgacgaccgcuucgccaccgcccugaccgcccucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcgcgggucagccagggggccggcuggagccuccgcgagaccgccugccuggggaaguccuacgcccagauguggcagcugauguacuuccaccggcgcgaccuccggcuggcggccaacgccaucugcagcgccgugcccguggacuggguccccacgucccgcaccaccuggagcauccacgcccaccaccaguggaugaccacggaggacaugcuguccguguggaaccggguguggaucgaggagaaccccuggauggaggacaagacccacaucagcuccugggaggacgucccguaccucggcaagcgcgaggaccaguggugcgggagccugaucggccugaccgcgcgcgccaccugggccacgaacauccagguggccaucaaccaggugcggcgccucaucggcaacgagaacuaccuggacuacaugaccuccaugaagcgguucaagaacgagagcgaccccgagggggcccugugguga

SEQ ID NO: 8879 - RNA, 9879 nt, Artificial Sequence
  derived and/or modified CDS sequence (opt1) from DENV-1__KC762625__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccgcaucaccgaggccgagcccgacgacguggacugcuggugcaacgccaccgacaccugggugaccuacgggaccugcagccagaccggcgagcaccggcgcgacaagcggagcguggcccuggcgccccacgugggccuggggcucgagacgcgcaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugagcaagcuggagggcaagaucguccaguacgagaaccucaaguacuccgugaucgugaccguccacaccggcgaccagcaccagguggggaacgagagcaccgagcacggcacgaccgcgaccaucacgccccaggcccccaccacggagauccagcugaccgacuacggggcccugacccucgacugcagcccccggaccggccuggacuucaacgagaugguccugcucacgaugaaggagaaguccuggcuggugcacaagcagugguuccuggaccucccccugcccuggaccagcggggccuccaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccaccgcccgcggggcccggcgcauggcgauccugggcgacaccgccugggacuucgggagcaucggcggcguguucacguccgucgggaagcucgugcaccagaucuucggcaccgccuacggggugcuguucagcggcgucuccuggaccaugaagaucgggaucggcgugcugcucaccuggcugggccugaacagccgcuccacgagccucuccaugaccugcaucgccguggggcuggucacccuguaccucggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucaccgugguggucggggacguggcgggcauccuggcccaggggaagaagaugauccggccccagcccauggagcacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagacguggaagcuggcgcgggccuccuucaucgaggucaagagcugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccguggucguggacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgucaaggagaaggaggagaaccucgucaagagcaugguguccgccggcagcggcgaggucgacuccuucagccuggggcugcucugcaucuccaucaugaucgaggaggugaugcggagccgcuggucccggaagaugcugaugacgggcacccuggccguguucuuccuccugaucauggggcagcugaccuggaacgaccucauccgccugugcaucauggucggcgcgaacgccagcgaccgcauggggaugggcaccacguaccuggcccucauggccaccuucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucacggacuuccagucccaccagcugugggccacccugcucagccugaccuucaucaagaccacguucucccugcacuacgccuggaagaccauggcgaugguccucagcaucgugucccuguucccccugugccucagcaccaccucccagaagacgaccuggcugcccgugcugcucggcagccuggggugcaagccgcugaccauguuccucaucgccgagaacaagaucuggggccgcaagagcuggccccugaacgaggggaucauggccgucggcaucguguccauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacgcucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacacgauguggcacgugacccgcggcgcgguccugauguaccaggggaagcggcuggagcccagcugggccuccgugaagaaggaccucaucagcuacggcggcggguggcgccugcagggcuccuggaacaccggggaggaggugcaggucaucgccguggagcccggcaagaaccccaagaacgugcagaccgcccccgggacguucaagacccccgagggcgaggucggcgccaucgcgcuggacuucaagcccgggaccagcggcagccccaucgugaaccgggaggggaagaucgugggccucuacggcaacggggucgugaccacguccggcaccuacgugagcgccaucgcccaggccaaggcgucccaggaggggccgcugcccgagaucgaggacgaggucuuccgcaagcggaaccugaccaucauggaccuccaccccggcagcgggaagacccgccgguaccugccggccaucgugcgcgaggccaucaagcggaagcugcgcacgcucauccuggcccccacccgcguggucgccuccgagauggcggaggcccugaagggcaugcccauccgguaccagaccaccgccgucaagagcgagcacacgggcaaggagaucguggaccucaugugccacgccaccuucaccaugcgccugcugucccccguccgggugccgaacuacaacaugaucaucauggacgaggcccacuucaccgaccccagcuccaucgcggcccgcggguacaucagcacgcgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagacggugugguucguccccuccaucaagagcggcaacgacaucgccaacugccuccgcaagaacgggaagcgggugauccagcugucccgcaagaccuucgacaccgaguaccagaagaccaagaacaacgacugggacuacguggucacgaccgacaucagcgagaugggcgcgaacuuccgggccgaccgcgugaucgacccgcggcgcugccugaagcccgugauccucaaggacgggcccgagcgggucauccuggccggccccaugccggugaccgucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacgcccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucagcuacaagguggccuccgagggcuuccaguacagcgaccggcgcuggugcuucgacggcgagcggaacaaccaggugcuggaggagaacauggacgucgagaucuggaccaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacgcagcgggcccagaacgcccuggacaaccuggugaugcuccacaacagcgagcagggcgggcgcgcguaccggcacgccauggaggagcugcccgacaccaucgagacccugaugcuccuggcccugaucgccguccucaccggcggggugacgcuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucaccguggccgcgaacgagaugggccugcuggagaccacgaagaaggaccucgggaucggccacgucgccguggagaaccaccaccacgccgccaugcuggacguggaccugcaccccgccuccgcguggacccucuacgccgucgccaccaccaucaucacgccgaugaugcggcacaccaucgagaacaccaccgccaacaucagccugacggccaucgcgaaccaggccgccauccugauggggcucgacaagggcuggcccaucuccaagauggacaucggcgugccccugcuggcccucgggugcuacagccaggugaacccccugacccugaccgcggccguccucaugcugguggcccacuacgccaucaucggcccggggcugcaggccaaggcgacccgcgaggcccagaagcgcacggccgccggcaucaugaagaaccccaccguggacgggaucgucgccaucgaccucgaccccgugguguacgacgcgaaguucgagaagcagcugggccagaucaugcugcucauccugugcaccucccagauccugcucaugcggaccacgugggcccugugcgagagcaucacccuggccaccggcccccucaccacgcugugggagggguccccgggcaaguucuggaacaccaccaucgccgucagcauggccaacaucuuccgcgggagcuaccuggcgggcgccggccucgccuucucccugaugaagucccucgggggcgggcggcgcgggaccggggcccagggcgagacgcucggcgagaaguggaagcggcagcugaaccagcuguccaagagcgaguucaacaccuacaagcgcuccgggaucauggagguggaccggagcgaggcgaaggagggccucaagcgcggggagaccaccaagcacgccgugucccggggcacggccaagcugcgcugguucgucgagcggaaccuggugaagcccgaggggaaggugaucgaccugggcugcggccgcgggggcuggagcuacuacugcgccgggcucaagaaggucaccgaggugaagggcuacaccaagggcgggcccggccacgaggagcccaucccgauggccaccuacggguggaaccuggugaagcugcacuccggcaaggacgucuucuucaucccgcccgagaagugcgacacgcuccugugcgacaucggggagagcucccccaacccgaccaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacgcacgagauguacugggucuccugcgggaccggcaacaucgugagcgcggugaacaugaccucccggaugcuccugaaccgcuucaccauggcccaccgcaagcccaccuacgagcgggacgucgaccugggggccggcacgcgccacguggccguggagcccgaggucgccaaccucgacaucaucggccagcggaucgagaacaucaagcacgagcacaagagcaccuggcacuacgacgaggacaaccccuacaagaccugggcguaccacggguccuacgaggugaagccgagcggcagcgccuccagcauggucaacgggguggugaagcugcugaccaagcccugggacgucauccccauggugacgcagaucgccaugaccgacaccacccccuucggccagcagcgcguguucaaggagaaggucgacacgcggaccccgaaggccaagcgcgggaccacccagaucauggaggugacggcccgguggcucuggggcuuccugucccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagccggagcacgcccugcuggcgaaggccaucuucaagcucacguaccagaacaaggucgugcgcgugcagcgccccgccaagaacgggaccgucauggacgugaucucccggcgcgaccagcggggcagcggccagguggggaccuacggccugaacaccuucacgaacauggaggcccagcugauccgccagauggaguccgaggggaucuucagccccuccgagcucgagacccccaaccuggccgagcggguccuggacuggcucgagaaguacggcguggagcgccugaagcggauggcgaucagcggggacgacugcguggucaagccgaucgacgaccgcuucgccaccgcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucagccagggggcgggcuggucccuccgcgagacggccugccugggcaagagcuacgcccagauguggcagcugauguacuuccaccggcgcgaccuccggcuggccgcgaacgccaucugcuccgccgugcccguggacuggguccccaccagccgcaccaccugguccauccacgcccaccaccaguggaugacgaccgaggacaugcugagcguguggaaccggguguggaucgaggagaaccccuggauggaggacaagacccacaucuccagcugggaggacgucccguaccucggcaagcgcgaggaccaguggugcgggucccugaucggccugaccgcccgcgcgacgugggccaccaacauccagguggccaucaaccaggugcggcgccucaucggcaacgagaacuaccuggacuacaugaccagcaugaagcgguucaagaacgaguccgaccccgagggggcccugugguga

SEQ ID NO: 8880 - RNA, 9879 nt, Artificial Sequence
  derived and/or modified CDS sequence (opt1) from DENV-1__KC762635__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccuggggcucgagacgcgcaccgagaccuggaugagcuccgagggcgccuggcggcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcagccgggacuucguggaggggcuguccggcgccacguggguggacgucgugcuggagcacgggagcugcgugaccaccauggccaaggacaagcccacccucgacaucgagcugcugaagacggaggucaccaaccccgcggugcuccgcaagcugugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccggacgggccuggacuucaacgagaugguccugcucaccaugaaggagaaguccuggcuggugcacaagcagugguuccuggaccucccccugcccuggaccagcggggccagcaccucccaggagacguggaaccgccaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccggcugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccgccgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccggagcaccucccucagcaugaccugcaucgccguggggcuggucacccuguaccucggcgugauggugcaggccgacuccgggugcgucaucaacuggaagggccgcgagcugaagugcgggagcggcaucuucgugacgaacgaggugcacaccuggaccgagcaguacaaguuccaggcggacagcccgaagcggcuguccgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacguggcgggcauccuggcccaggggaagaagaugauccgcccccagcccauggagcacaaguacagcuggaaguccuggggcaaggccaagaucaucggcgccgacgugcagaacacgaccuucaucaucgacgggcccaacaccccggagugccccgacgaccagcgggcguggaacaucugggaggucgaggacuacggcuucgggaucuucaccacgaacaucuggcugaagcuccgcgacagcuacacccaggugugcgaccaccggcugauguccgccgccaucaaggacagcaaggccgugcacgccgacaugggcuacuggaucgaguccgagaagaacgagaccuggaagcuggcgcgcgccagcuucaucgaggucaagaccugcaucuggcccaagucccacacgcucuggagcaacggcgugcuggaguccgagaugaucauccccaagaucuacgggggcccgaucagccagcacaacuaccggcccggguacuucacccagaccgccggccccuggcaccuggggaagcucgagcuggacuucaaccugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugacguggaacgaccucauccgccugugcaucauggucggcgcgaacgccagcgaccggauggggaugggcaccaccuaccuggcccucauggccaccuucaagaugcgcccgauguucgccgugggccugcuguuccggcgccucacgucccgggaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgcaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccucuacggcaacggggucgugaccaccagcggcaccuacgugagcgccaucgcccaggccaaggcgucccaggaggggccgcugcccgagaucgaggacgaggucuuccggaagcgcaaccugacgaucauggaccuccaccccggcagcgggaagacccggcgcuaccugccggccaucgugcgggaggccaucaagcgcaagcugcgcacccucauccuggcccccacccggguggucgccuccgagauggcggaggcccugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugacggucgccuccgccgcgcagcggcgcgggcgggugggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucacgguggccgcgaacgagaugggccugcuggagaccaccaagaaggaccucgggaucggccacgucgccguggagaaccaccaccacgccgccaugcuggacguggaccugcaccccgccuccgcguggacccucuacgccgucgccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggugaacccccugacccugacggcggccguccucaugcugguggcccacuacgccaucaucggcccggggcugcaggccaaggcgacccgcgaggcccagaagcggaccgccgccggcaucaugaagaaccccaccguggacgggaucgucgccaucgaccucgaccccgugguguacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgugucccgcggcaccgccaagcugcggugguucgucgagcgcaaccuggugaagcccgaggggaaggugaucgaccugggcugcggccgcggcggguggagcuacuacugcgccgggcucaagaaggucaccgaggugaagggguacacgaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccgcacgcugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugaccucccgcaugcuccugaaccgcuucacgauggcccaccggaagcccaccuacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcggguguucaaggagaaggucgacacccgcaccccgaaggccaagcgggggacgacccagaucauggaggugaccgcccgcuggcucuggggcuuccugucccggaacaagaagccccgcaucugcacccgggaggaguucacgcgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucacggaggacgaccuccagaacgaggccaagaucaccgacaucauggagccggagcacgcccugcuggcgaaggccaucuucaagcucaccuaccagaacaaggucgugcgcgugcagcggcccgccaagaacgggaccgucauggacgugaucucccgccgggaccagcgcggcagcggccaggugggcacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggcgaucagcggggacgacugcguggucaagccgaucgacgaccgguucgccacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggcgggcuggagccuccgggagaccgccugccugggcaagagcuacgcccagauguggcagcugauguacuuccaccgccgggaccuccgccuggccgcgaacgccaucugcuccgccgugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcugggaggacgucccguaccucggcaagcgcgaggaccaguggugcgggucccugaucggccugaccgcccgggcgaccugggccaccaacauccagguggccaucaaccaggugcgccggcucaucggcaacgagaacuaccuggacuacaugaccagcaugaagcgcuucaagaacgaguccgaccccgagggggcccugugguga

SEQ ID NO: 8881 - RNA, 9879 nt, Artificial Sequence
  derived and/or modified CDS sequence (opt1) from DENV-1__KC762650__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccuggggcucgagacgcgcaccgagaccuggaugagcuccgagggcgccuggcggcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcagccgggacuucguggaggggcuguccggcgccacguggguggacgucgugcuggagcacgggagcugcgugaccaccauggccaaggacaagcccacccucgacaucgagcugcugaagacggaggucaccaaccccgcggugcuccgcaagcugugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccggacgggccuggacuucaacgagaugguccugcucaccaugaaggagaaguccuggcuggugcacaagcagugguuccuggaccucccccugcccuggaccagcggggccagcaccucccaggagacguggaaccgccaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccggcugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccgccgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccggagcaccucccucagcaugaccugcaucgccguggggcuggucacccuguaccucggcgugauggugcaggccgacuccgggugcgucaucaacuggaagggccgcgagcugaagugcgggagcggcaucuucgugacgaacgaggugcacaccuggaccgagcaguacaaguuccaggcggacagcccgaagcggcuguccgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacguggcgggcauccuggcccaggggaagaagaugauccgcccccagcccauggagcacaaguacagcuggaaguccuggggcaaggccaagaucaucggcgccgacgugcagaacacgaccuucaucaucgacgggcccaacaccccggagugccccgacgaccagcgggcguggaacaucugggaggucgaggacuacggcuucgggaucuucaccacgaacaucuggcugaagcuccgcgacagcuacacccaggugugcgaccaccggcugauguccgccgccaucaaggacagcaaggccgugcacgccgacaugggcuacuggaucgaguccgagaagaacgagaccuggaagcuggcgcgcgccagcuucaucgaggucaagaccugcaucuggcccaagucccacacgcucuggagcaacggcgugcuggaguccgagaugaucauccccaagaucuacgggggcccgaucagccagcacaacuaccggcccggguacuucacccagaccgccggccccuggcaccuggggaagcucgagcuggacuucaaccugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugacguggaacgaccucauccgccugugcaucauggucggcgcgaacgccagcgaccggauggggaugggcaccaccuaccuggcccucauggccaccuucaagaugcgcccgauguucgccgugggccugcuguuccggcgccucacgucccgggaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgcaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccucuacggcaacggggucgugaccaccagcggcaccuacgugagcgccaucgcccaggccaaggcgucccaggaggggccgcugcccgagaucgaggacgaggucuuccggaagcgcaaccugacgaucauggaccuccaccccggcagcgggaagacccggcgcuaccugccggccaucgugcgggaggccaucaagcgcaagcugcgcacccucauccuggcccccacccggguggucgccuccgagauggcggaggcccugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugacggucgccuccgccgcgcagcggcgcgggcgggugggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccaucgaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucacgguggccgcgaacgagaugggccugcuggagaccaccaagaaggaccucgggaucggccacgucgccguggagaaccaccaccacgccgccaugcuggacguggaccugcaccccgccuccgcguggacccucuacgccgucgccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggugaacccccugacccugacggcggccguccucaugcugguggcccacuacgccaucaucggcccggggcugcaggccaaggcgacccgcgaggcccagaagcggaccgccgccggcaucaugaagaaccccaccguggacgggaucgucgccaucgaccucgaccccgugguguacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgugucccgcggcaccgccaagcugcggugguucgucgagcgcaaccuggugaagcccgaggggaaggugaucgaccugggcugcggccgcggcggguggagcuacuacugcgccgggcucaagaaggucaccgaggugaagggguacacgaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccgcacgcugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugaccucccgcaugcuccugaaccgcuucacgauggcccaccggaagcccaccuacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcggguguucaaggagaaggucgacacccgcaccccgaaggccaagcgggggacgacccagaucauggaggugaccgcccgcuggcucuggggcuuccugucccggaacaagaagccccgcaucugcacccgggaggaguucacgcgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucacggaggacgaccuccagaacgaggccaagaucaccgacaucauggagccggagcacgcccugcuggcgaaggccaucuucaagcucaccuaccagaacaaggucgugcgcgugcagcggcccgccaagaacgggaccgucauggacgugaucucccgccgggaccagcgcggcagcggccaggugggcacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggcgaucagcggggacgacugcguggucaagccgaucgacgaccgguucgccacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggcgggcuggagccuccgggagaccgccugccugggcaagagcuacgcccagauguggcagcugauguacuuccaccgccgggaccuccgccuggccgcgaacgccaucugcuccgccgugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcugggaggacgucccguaccucggcaagcgcgaggaccaguggugcgggucccugaucggccugaccgcccgggcgaccugggccaccaacauccagguggccaucaaccaggugcgccggcucaucggcaacgagaacuaccuggacuacaugaccagcaugaagcgcuucaagaacgaguccgaccccgagggggcccugugguga

SEQ ID NO: 8882 - RNA, 9879 nt, Artificial Sequence
  derived and/or modified CDS sequence (opt1) from DENV-1__KC762623__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggggagcugugcgaggacacccucaccuacaagugcccccgcaucaccgaggccgagcccgacgacguggacugcuggugcaacgccaccgacaccugggugaccuacgggaccugcagccagaccggggagcaccggcgcgacaagcggagcguggcccuggcgccccacgugggccuggggcucgagacgcgcaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcggccuguucggcaaggggucccugaucacgugcgccaaguucaagugcgugagcaagcuggagggcaagaucguccaguacgagaaccucaaguacuccgugaucgugaccguccacaccggcgaccagcaccagguggggaacgagagcaccgagcacggcacgaccgcgaccaucacgccccaggcccccaccacggagauccagcugaccgacuacggggcccugacccucgacugcagcccccggaccggccuggacuucaacgagaugguccugcucacgaugaaggagaaguccuggcuggugcacaagcagugguuccuggaccucccccugcccuggaccagcggggccuccaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccaccgcccgcggggcccggcgcauggcgauccugggcgacaccgccugggacuucgggagcaucggcggcguguucacguccgucgggaagcucgugcaccagaucuucggcaccgccuacggggugcuguucagcggcgucuccuggaccaugaagaucgggaucggcgugcugcucaccuggcugggccugaacagccgcuccacgagccucuccaugaccugcaucgccguggggcuggucacccuguaccucggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucaccgugguggucggggacguggcgggcauccuggcccaggggaagaagaugauccggccccagcccauggagcacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagacguggaagcuggcgcgggccuccuucaucgaggucaagagcugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccguggucguggacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgucaaggagaaggaggagaaccucgucaagagcaugguguccgccggcagcggcgaggucgacuccuucagccuggggcugcucugcaucuccaucaugaucgaggaggugaugcggagccgcuggucccggaagaugcugaugacgggcacccuggccguguucuuccuccugaucauggggcagcugaccuggaacgaccucauccgccugugcaucauggucggcgcgaacgccagcgaccgcauggggaugggcaccacguaccuggcccucauggccaccuucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucacggacuuccagucccaccagcugugggccacccugcucagccugaccuucaucaagaccacguucucccugcacuacgccuggaagaccauggcgaugguccucagcaucgugucccuguucccccugugccucagcaccaccucccagaagacgaccuggcugcccgugcugcucggcagccuggggugcaagccgcugaccauguuccucaucgccgagaacaagaucuggggccgcaagagcuggccccugaacgaggggaucauggccgucggcaucguguccauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacgcucaccauccugcugaaggccacccuccuggccguguccggcguguacccgcugagcauccccgccacccucuuccugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacacgauguggcacgugacccgcggcgcggugcugauguaccaggggaagcggcucgagcccagcugggccuccgucaagaaggaccugaucagcuacggcggcggguggcgccugcagggcuccuggaacaccggggaggagguccaggugaucgccgucgagcccggcaagaaccccaagaacgugcagaccgcccccgggacguucaagacccccgagggcgaggugggcgccaucgcgcucgacuucaagcccgggaccagcggcagccccaucgucaaccgggaggggaagaucgugggccuguacggcaacgggguggucaccacguccggcaccuacgugagcgccaucgcccaggccaaggcgucccaggaggggccgcugcccgagaucgaggacgagguguuccgcaagcggaaccucaccaucauggaccugcaccccggcagcgggaagacccgccgguaccugccggccaucguccgcgaggccaucaagcggaagcuccgcacgcugauccuggcccccacccgcgugguggccuccgagauggcggaggcccucaagggcaugcccauccgguaccagaccaccgccgucaagagcgagcacacgggcaaggagaucguggaccugaugugccacgccaccuucaccaugcgccugcucucccccgugcgggucccgaacuacaacaugaucaucauggacgaggcccacuucaccgaccccagcuccaucgcggcccgcggguacaucagcacgcgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagacggugugguucgugcccuccaucaagagcggcaacgacaucgccaacugccugcgcaagaacgggaagcgggucauccagcugucccgcaagaccuucgacaccgaguaccagaagaccaagaacaacgacugggacuacguggugacgaccgacaucagcgagaugggcgcgaacuuccgggccgaccgcgucaucgacccgcggcgcugccucaagcccgugauccugaaggacgggcccgagcgggugauccuggccggccccaugccggucaccguggccuccgccgcgcagcgccgggggcgcgucggccggaaccacaacaaggagggcgaccaguacaucuacauggggcagccccucaacaacgacgaggaccacgcccacuggaccgaggccaagaugcugcuggacaacaucaacacgcccgagggcaucauccccgcccucuucgagccggagcgcgagaaguccgccgcgaucgacggggaguaccgccugcggggcgaggcccgcaagaccuucguggagcugaugcggcgcggggaccuccccguguggcugagcuacaaggucgccuccgagggcuuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccccuggcccuccgcgaguucaaggaguucgcggccggccggcgcagcgucuccggggaccugauccuggagaucggcaagcucccgcagcaccugacgcagcgggcccagaacgcccuggacaaccucgugaugcugcacaacagcgagcagggcgggcgcgcguaccggcacgccauggaggagcugcccgacaccaucgagacccucaugcugcuggcccucaucgccgugcugaccggcggggucacgcuguucuuccucuccggccgcgggcugggcaagaccagcaucggccugcucugcgugauggccuccagcgugcugcuguggauggcguccgucgagccccacuggaucgccgccagcaucauccucgaguucuuccugauggugcugcucauccccgagccggaccggcagcgcacgccccaggacaaccagcuggccuacguggucaucgggcuccucuucaugauccugaccguggccgcgaacgagaugggccugcucgagaccacgaagaaggaccuggggaucggccacguggccgucgagaaccaccaccacgccgccaugcuggacguggaccuccaccccgccuccgcguggacccuguacgccguggccaccaccaucaucacgccgaugaugcggcacaccaucgagaacaccaccgccaacaucagccugacggccaucgcgaaccaggccgccauccucauggggcuggacaagggcuggcccaucuccaagauggacaucggcgucccccugcucgcccuggggugcuacagccaggugaacccccugacccucaccgcggccgugcugaugcuggucgcccacuacgccaucaucggcccggggcuccaggccaaggcgacccgcgaggcccagaagcgcacggccgccggcaucaugaagaaccccaccguggacgggaucguggccaucgaccuggaccccgucguguacgacgcgaaguucgagaagcagcugggccagaucaugcuccugauccugugcaccucccagauccuccugaugcggaccacgugggcccugugcgagagcaucacccucgccaccggcccccugaccacgcugugggagggguccccgggcaaguucuggaacaccaccaucgccgugagcauggccaacaucuuccgcgggagcuaccucgcgggcgccggccuggccuucucccugaugaagucccucgggggcgggcggcgcggcaccggggcccagggcgagacgcugggcgagaaguggaagcggcagcugaaccagcucuccaagagcgaguucaacaccuacaagcgcuccgggaucauggaggucgaccggagcgaggcgaaggagggccugaagcgcggggagaccaccaagcacgccgugucccggggcacggccaagcugcgcugguucguggagcggaaccuggucaagcccgaggggaaggugaucgaccucggcugcggccgcgggggcuggagcuacuacugcgccgggcugaagaaggugaccgaggucaagggcuacaccaagggcgggcccggccacgaggagcccaucccgauggccaccuacggguggaaccuggugaagcuccacuccggcaaggacguguucuucaucccgcccgagaagugcgacacgcugcugugcgacaucggggagagcucccccaacccgaccaucgaggagggccggacccuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacgcacgagauguacuggguguccugcgggaccggcaacaucgucagcgcggugaacaugaccucccggaugcugcugaaccgcuucaccauggcccaccgcaagcccaccuacgagcgggacguggaccucggggccggcacgcgccacgucgccguggagcccgagguggccaaccuggacaucaucggccagcggaucgagaacaucaagcacgagcacaagagcaccuggcacuacgacgaggacaaccccuacaagaccugggcguaccacggguccuacgaggucaagccgagcggcagcgccuccagcauggugaacggggucgugaagcugcucaccaagcccugggacgugauccccauggucacgcagaucgccaugaccgacaccacccccuucggccagcagcgcguguucaaggagaagguggacacgcggaccccgaaggccaagcgcgggaccacccagaucauggaggucacggcccgguggcuguggggcuuccugucccgcaacaagaagccccggaucugcacccgcgaggaguucacccggaaggugcgcagcaacgcggccaucggcgccguguucgucgacgagaaccaguggaacuccgccaaggaggcgguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagccggagcacgcccugcucgcgaaggccaucuucaagcugacguaccagaacaaggugguccgcgugcagcgccccgccaagaacgggaccgugauggacgucaucucccggcgcgaccagcggggcagcggccagguggggaccuacggccugaacaccuucacgaacauggaggcccagcucauccgccagauggaguccgaggggaucuucagccccuccgagcuggagacccccaaccuggccgagcgggugcucgacuggcuggagaaguacggcgucgagcgccugaagcggauggcgaucagcggggacgacugcguggugaagccgaucgacgaccgcuucgccaccgcccucaccgcccugaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcucgugggccgcgcccgggugagccagggggcgggcuggucccugcgcgagacggccugccugggcaagagcuacgcccagauguggcagcucauguacuuccaccggcgcgaccugcggcuggccgcgaacgccaucugcuccgccguccccguggacugggugcccaccagccgcaccaccugguccauccacgcccaccaccaguggaugacgaccgaggacaugcucagcgucuggaaccggguguggaucgaggagaaccccuggauggaggacaagacccacaucuccagcugggaggacgugccguaccugggcaagcgcgaggaccaguggugcgggucccugaucggccucaccgcccgcgcgacgugggccaccaacauccaggucgccaucaaccaggugcggcgccugaucggcaacgagaacuaccuggacuacaugaccagcaugaagcgguucaagaacgaguccgaccccgagggggcccucugguga

SEQ ID NO: 8883 - RNA, 9879 nt, Artificial Sequence
  derived and/or modified CDS sequence (opt1) from DENV-1__KC762632__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacccucaccuacaagugcccccggaucaccgaggccgagcccgacgacguggacugcuggugcaacgccaccgacaccugggugaccuacgggaccugcagccagaccggcgagcaccggcgggacaagcgguccguggcccuggcgccccacgugggccuggggcucgagacccgcaccgagaccuggaugagcuccgagggcgccuggcggcagaugcagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcagccgggacuucguggaggggcuguccggcgccacguggguggacgucgugcuggagcacgggagcugcgugaccaccauggccaaggacaagcccacccucgacaucgagcugcugaagacggaggucaccaaccccgcggugcuccgcaagcugugcaucgaggccaagaucuccaacaucaccaccgacagccggugcccgacgcagggcgaggccacccugguggaggagcaggacgccaacuucgucugccgccggaccuucguggaccgcggcugggggaacggcugcgggcuguucggcaaggggucccugaucacgugcgccaaguucaagugcgugacgaagcuggagggcaagaucguccaguacgagaaccucaaguacagcgugaucgugaccguccacaccggcgaccagcaccagguggggaacgaguccaccgagcacggcacgaccgcgaccaucacgccccaggcccccaccacggagauccagcugaccgacuacggggcccugacccucgacugcagcccccggaccggccuggacuucaacgagaugguccugcucacgaugaaggagaaguccuggcuggugcacaagcagugguuccuggaccucccccugcccuggaccagcggggccagcaccucccaggagaccuggaaccgccaggaccugcucgugacguucaagaccgcccacgcgaagaagcaggaggucguggugcugggcagccaggagggcgccaugcacaccgcccugaccggggccacggagauccagaccuccggcaccaccacgaucuucgccgggcaccucaagugccggcugaagauggacaagcugacccucaagggcaugagcuacgucaugugcaccggguccuucaagcuggagaaggagguggcggagacccagcacggcacggugcugguccagaucaaguacgagggcaccgacgcccccugcaagauccccuucagcacccaggacgagaagggggugacccagaacggccgccugaucacggccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccgccgcauggcgauccugggcgacaccgccugggacuucggguccaucggcggcguguucacgagcgucgggaagcucgugcaccagaucuucggcaccgccuacggggugcuguucuccggcgucagcuggaccaugaagaucgggaucggcgugcugcucaccuggcugggccugaacucccggagcacgucccucagcaugaccugcaucgccguggggcuggucacccuguaccucggcgugauggugcaggccgacuccgggugcgucaucaacuggaagggccgcgagcugaagugcgggagcggcaucuucgugaccaacgaggugcacacguggaccgagcaguacaaguuccaggcggacagcccgaagcggcuguccgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacguggcgggcauccuggcccaggggaagaagaugauccgcccccagcccauggagcacaaguacagcuggaaguccuggggcaaggccaagaucaucggcgccgacgugcagaacaccacguucaucaucgacgggcccaacaccccggagugccccgacgaccagcgggcguggaacaucugggaggucgaggacuacggcuucgggaucuucaccaccaacaucuggcugaagcuccgcgacagcuacacccaggugugcgaccaccggcugauguccgccgccaucaaggacagcaaggccgugcacgccgacaugggcuacuggaucgaguccgagaagaacgagacguggaagcuggcgcgcgccagcuucaucgaggucaagaccugcaucuggcccaagucccacacccucuggagcaacggcgugcuggaguccgagaugaucauccccaagaucuacgggggcccgaucagccagcacaacuaccggcccggguacuucacgcagaccgccggccccuggcaccuggggaagcucgagcuggacuucaaccugugcgagggcaccaccguggucguggacgagcacugcggcaaccgcgggccgucccuccggacgaccaccgugaccggcaagaucauccacgaguggugcugccgcagcugcacgcugccgccccugcgguuccgcggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugaccuggaacgaccucauccgccugugcaucauggucggcgcgaacgccagcgaccggauggggaugggcacgaccuaccuggcccucauggccaccuucaagaugcgcccgauguucgccgugggccugcuguuccggcgccucaccucccgggaggugcugcugcucacgaucgggcugagccuggucgcguccguggagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgccuggaagaccauggcgaugguccucagcaucgugucccuguucccccugugccucagcaccacgucccagaagaccaccuggcugcccgugcugcucggcagccuggggugcaagccgcugaccauguuccucaucgccgagaacaagaucuggggccgcaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggacgaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacgcccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacaccggggaggaggugcaggucaucgccguggagcccggcaagaaccccaagaacgugcagacggcccccgggaccuucaagacccccgagggcgaggucggcgccaucgcgcuggacuucaagcccgggaccagcggcucccccaucgugaaccgcgaggggaagaucgugggccucuacggcaacggggucgugacgaccagcggcaccuacgugagcgccaucgcccaggccaaggcgucccaggaggggccgcugcccgagaucgaggacgaggucuuccggaagcgcaaccugaccaucauggaccuccaccccggcagcgggaagacgcggcgcuaccugccggccaucgugcgggaggccaucaagcgcaagcugcgcacccucauccuggcccccacccggguggucgccuccgagauggcggaggcccugaagggcaugcccauccgcuaccagaccacggccgucaagagcgagcacaccggcaaggagaucguggaccucaugugccacgccaccuucaccaugcggcugcugucccccguccgcgugccgaacuacaacaugaucaucauggacgaggcccacuucacggaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucacggacuuccccggcaagaccgugugguucguccccuccaucaagagcggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugaccgucgccuccgccgcgcagcggcgcgggcgggugggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacccugaugcuccuggcccugaucgccguccucacgggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagacgaccaagaaggaccucgggaucggccacgucgccguggagaaccaccaccacgccgccaugcuggacguggaccugcaccccgccuccgcguggacccucuacgccgucgccaccacgaucaucaccccgaugaugcgccacaccaucgagaacaccacggccaacaucagccugaccgccaucgcgaaccaggccgccauccugauggggcucgacaagggcuggcccaucuccaagauggacaucggcgugccccugcuggcccucgggugcuacagccaggugaacccccugacccugaccgcggccguccucaugcugguggcccacuacgccaucaucggcccggggcugcaggccaaggcgacgcgcgaggcccagaagcggaccgccgccggcaucaugaagaaccccaccguggacgggaucgucgccaucgaccucgaccccgugguguacgacgcgaaguucgagaagcagcugggccagaucaugcugcucauccugugcaccucccagauccugcucaugcgcacgaccugggcccugugcgagagcaucacccuggccaccggcccccucacgacccugugggagggguccccgggcaaguucuggaacaccaccaucgccgucagcauggccaacaucuuccggggguccuaccuggcgggcgccggccucgccuucagccugaugaagucccucgggggcgggcgccgggggacgggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagaccacgaagcacgccgugucccgcggcaccgccaagcugcggugguucgucgagcgcaaccuggugaagcccgaggggaaggugaucgaccugggcugcggccgcggcggguggagcuacuacugcgccgggcucaagaaggucaccgaggugaagggguacaccaagggcgggcccggccacgaggagcccaucccgauggccacguacggguggaaccuggugaagcugcacuccggcaaggacgucuucuucaucccgcccgagaagugcgacacccuccugugcgacaucggggagagcucccccaacccgaccaucgaggagggccgcacccugcgggugcucaagaugguggagcccuggcugcgcgggaaccaguucugcaucaagauccugaaccccuacaugcccagcgucguggagacgcucgaccagaugcagcggaagcacggcggcaugcuggugcgcaacccgcugucccggaacagcacccacgagauguacugggucuccugcgggaccggcaacaucgugagcgcggugaacaugaccucccgcaugcuccugaaccgcuucaccauggcccaccggaagcccacguacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagaccugggcguaccacggguccuacgaggugaagccgagcggcuccgccagcagcauggucaacgggguggugaagcugcugacgaagcccugggacgucauccccauggugacccagaucgccaugaccgacaccacgcccuucggccagcagcggguguucaaggagaaggucgacacccgcaccccgaaggccaagcgggggaccacgcagaucauggaggugaccgcccgcuggcucuggggcuuccugucccggaacaagaagccccgcaucugcacccgggaggaguucacccgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgccacgugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucaccgaggacgaccuccagaacgaggccaagaucacggacaucauggagccggagcacgcccugcuggcgaaggccaucuucaagcucaccuaccagaacaaggucgugcgcgugcagcggcccgccaagaacgggaccgucauggacgugaucucccgccgggaccagcgcggcagcggccaggugggcaccuacggccugaacacguucaccaacauggaggcccagcugauccggcagauggaguccgaggggaucuucagccccuccgagcucgagacccccaaccuggccgagcgcguccuggacuggcucgagaaguacggcguggagcggcugaagcgcauggcgaucagcggggacgacugcguggucaagccgaucgacgaccgguucgccaccgcccugacggcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggcgggcuggagccuccgggagaccgccugccugggcaagagcuacgcccagauguggcagcugauguacuuccaccgccgggaccuccgccuggccgcgaacgccaucugcuccgccgugcccguggacuggguccccaccagccggaccacgugguccauccacgcccaccaccaguggaugaccaccgaggacaugcugagcguguggaaccgcguguggaucgaggagaaccccuggauggaggacaagacccacaucuccagcugggaggacgucccguaccucggcaagcgcgaggaccaguggugcgggucccugaucggccugacggcccgggcgaccugggccaccaacauccagguggccaucaaccaggugcgccggcucaucggcaacgagaacuaccuggacuacaugaccagcaugaagcgcuucaagaacgaguccgaccccgagggggcccugugguga

SEQ ID NO: 8884 - RNA, 9879 nt, Artificial Sequence
  derived and/or modified CDS sequence (opt1) from DENV-1__KC762637__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucacgguggccgcgaacgagaugggccugcuggagaccaccaagaaggaccucgggaucggccacgucgccguggagaaccaccaccacgccgccaugcuggacguggaccugcaccccgccuccgcguggacccucuacgccgucgccacgaccaucaucaccccgaugaugcggcacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggugaacccccugacccugacggcggccguccucaugcugguggcccacuacgccaucaucggcccggggcugcaggccaaggcgacccgcgaggcccagaagcgcaccgccgccggcaucaugaagaaccccaccguggacgggaucgucgccaucgaccucgaccccgugguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgucagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggagguggaccggagcgaggcgaaggagggccucaagcgcggggagacgaccaagcacgccgugucccggggcaccgccaagcugcgcugguucgucgagcggaaccuggugaagcccgaggggaaggugaucgaccugggcugcggccgcgggggcuggagcuacuacugcgccgggcucaagaaggucaccgaggugaagggcuacacgaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccggacgcugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugaccucccggaugcuccugaaccgcuucacgauggcccaccgcaagcccaccuacgagcgggacgucgaccugggggccggcacccgccacguggccguggagcccgaggucgccaaccucgacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcgcguguucaaggagaaggucgacacccggaccccgaaggccaagcgcgggacgacccagaucauggaggugaccgcccgguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaaggucgugcgcgugcagcgccccgccaagaacgggaccgucauggacgugaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcggguccuggacuggcucgagaaguacggcguggagcgccugaagcggauggcgaucagcggggacgacugcguggucaagccgaucgacgaccgcuucgccacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggcgggcuggagccuccgcgagaccgccugccugggcaagagcuacgcccagauguggcagcugauguacuuccaccggcgcgaccuccggcuggccgcgaacgccaucugcuccgccgugcccguggacuggguccccaccagccgcacgaccugguccauccacgcccaccaccaguggaugaccaccgaggacaugcugagcguguggaaccggguguggaucgaggagaaccccuggauggaggacaagacgcacaucuccagcugggaggacgucccguaccucggcaagcgcgaggaccaguggugcgggucccugaucggccugaccgcccgcgcgaccugggccaccaacauccagguggccaucaaccaggugcggcgccucaucggcaacgagaacuaccuggacuacaugaccagcaugaagcgguucaagaacgaguccgaccccgagggggcccugugguga

SEQ ID NO: 8885 - RNA, 9879 nt, Artificial Sequence
  derived and/or modified CDS sequence (opt1) from DENV-1__KC762620__SS-prME
agcgugaccaugcuguucaugcuccugcccaccgcccuggccuuccaccucaccacccgcggcggggagccccacaugaucguguccaagcaggagcggggcaagagccugcuguucaagaccuccgccggggugaacaugugcacccucaucgccauggaccugggcgagcugugcgaggacacgaugaccuacaagugcccccgcaucaccgagaccgagcccgacgacguggacugcuggugcaacgccacggagaccugggugaccuacgggaccugcagccagacgggcgagcaccggcgcgacaagcgguccguggcccucgcgccccacgugggccuggggcuggagacccgcaccgagaccuggaugagcuccgagggcgccuggaagcagauccagaagguggagacgugggcccuccggcaccccggguucaccgugaucgcccuguuccuggcccacgcgaucggcaccagcaucacccagaaggggaucaucuucauccuccugaugcuggugacgcccuccauggccaugcgcugcgucggcaucggcaaccgggacuucguggaggggcucagcggcgccaccuggguggacgucgugcuggagcacggguccugcgugaccaccauggccaaggacaagcccacgcuggacaucgagcuccugaagaccgaggucaccaaccccgccgugcugcgcaagcucugcaucgaggcgaagaucagcaacaccacgaccgacucccggugcccgacccagggcgaggccacccugguggaggagcaggacacgaacuucgucugccgccggaccuucguggaccgcggcugggggaacggcugcgggcuguucggcaaggggagccucaucacgugcgccaaguucaagugcgugaccaagcuggagggcaagaucguccaguacgagaaccugaaguacuccgugaucgugacgguccacaccggcgaccagcaccagguggggaacgagaccaucgagcacggcaccaccgccacgaucacgccccaggcccccaccagcgagauccagcucaccgacuacggggcgcugacgcuggacugcagcccccggaccggccucgacuucaacgagaugguccugcugaccaugaaggagaaguccuggcucgugcacaagcagugguuccuggaccugccgcuccccuggaccuccggggccagcacgagccaggagaccuggaaccgccaggaccugcuggugaccuucaagaccgcccacgccaagaagcaggaggucguggugcucggcucccaggagggcgccaugcacacggcgcugaccggggccaccgagauccagaccagcggcacgaccaccaucuucgccgggcaccugaagugccggcucaagauggacaagcugacccugaagggcgucuccuacgugaugugcacggggagcuucaagcucgagaaggagguggccgagacccagcacggcaccguccugguccaggugaaguacgagggcaccgacgcccccugcaagauccccuucuccagccaggacgagcgcggggucauccagaacggccggcugaucacggcgaacccgaucgugaccgacaaggagaagcccgugaacaucgaggccgagccgcccuucggggaguccuacaucgucgugggcgccggcgagaaggcccugaagcucagcugguucaagaagggguccagcaucggcaagauguucgaggcgaccgcccgcggggcccggcgcauggccauccugggcgacaccgccugggacuucggguccaucggcggcguguucacgagcgucgggaagcuggugcaccagaucuucggcaccgcguacggggugcuguucuccggcgucagcuggaccaugaagaucgggaucggcauccugcugaccuggcucggccugaacucccgcaacacgagccuguccaugaccugcaucgccguggggauggugacccucuaccugggcgucauggugcaggccgacagcgggugcgugaucaacuggaagggccgggagcugaagugcggguccggcaucuucgucaccaacgaggugcacacguggaccgagcaguacaaguuccaggccgacagcccgaagcgccucagcgccgcgaucggcaaggccugggaggagggggugugcggcauccgguccgccacccgccuggagaacaucauguggaagcagaucagcaacgagcugaaccacauccuccuggagaacgacaugaaguucaccgucguggugggggacgucuccggcauccuggcccaggggaagaagaugauccggccccagcccauggagcacaaguacagcuggaaguccuggggcaaggccaagaucaucggcgcggacgugcagaacaccacguucaucaucgacgggcccaacaccccggagugccccgacaaccagcgcgccuggaacaucugggagguggaggacuacggcuucggggucuucaccaccaacaucuggcucaagcugcgggacagcuacacccaggugugcgaccaccgccugauguccgccgccaucaaggacagcaaggcggugcacgccgacaugggcuacuggaucgaguccgagaagaacgagaccuggaagcucgagcgggccagcuucaucgaggucaagaccugcaucuggccccgcucccacacccuguggagcaacggcgugcuggaguccgagaugaucauccccaagacguacgggggcccggugagccagcacaacuaccggcccggguacuucacccagaccgccggccccuggcaccucgggaagcuggagcuggacuucgaccucugcgagggcaccacggucgugguggacgagaacugcggcaaccgcgggccgucccugcggaccaccaccgucacgggcaagaucauccacgaguggugcugccgcagcugcacccugccgccccuccgguucaagggggaggacggcugcugguacgggauggagauccgccccgugaaggagaaggaggagaaccuggugaaguccauggucagcgccggcagcggcgagguggacuccuucagccuggggcuccugugcaucuccaucaugaucgaggaggugaugcggagccgcugguccggcaagaugcugaugaccgggacccucgcggucuuccugcugcucacgaugggccagcugaccuggaacgaccugauccggcucugcaucauggugggggccaacgccagcgacaugaugggcaugggcaccaccuaccuggcccugauggccacguuccgcaugcgcccgauguucgcggucgggcuccuguuccggcgccugaccucccgggaggugcuccugcugaccgugggccucagccuggccgccuccgucgagcugcccaacagccucgaggagcugggggacggccuggccaugggcaucaugaugcucaagcugcugaccgacuuccagucccaccagcucugggccacgcugcugagccucaccuucgugaagaccaccuucucccugcacuacgcguggaagacgauggccaugauccugagcaucgugucccucuucccccugugccugagcaccaccucccagaagaccacguggcuccccguccugcuggggagccucggcugcaagccgcugaccaugcugcucaucaccgagaacaagaucugggggcgccgguccuggcccaucaacgagggcaucauggccaucgggaucgugagcauccugcugagcucccuccugaagaacgacgugccccuggccggcccccucaucgcgggcgggaugcugaucgccugcuacgucaucagcggcuccagcgccgaccugucccucgagaaggccgccgaggugagcugggaggacgaggcggagcacuccggggccagccacaacauccugguggagguccaggacgacggcaccaugaagaucaaggacgaggagcgcgacgacacccugacgauccuccugaaggccacccugcucgccaucuccgggguguacccgaugagcauccccgccacccuguucgugugguacuucuggcagaagaagaagcagcgguccggcguccugugggacacccccagcccgcccgagguggagcgcgcggugcucgacgacggcaucuaccggauccugcagcgcgggcugcugggccggucccaggucggggugggcguguuccaggagggggucuuccacacgauguggcacgugacccgcggcgccgugcucauguaccagggcaagcggcuggagcccagcugggccuccgucaagaaggaccugaucagcuacgggggcggguggcgcuuccagggcuccuggaacaccggggaggagguccaggugaucgccgucgagcccggcaagaaccccaagaacgugcagaccacgcccggcaccuucaagaccagcgagggggaggugggcgccaucgcgcucgacuucaagcccgggaccuccggcagccccaucgucaaccgggagggcaagaucguggggcuguacggcaacgggguggucacgaccagcggcaccuacguguccgccaucgcccaggccaaggccagccaggaggggccccugccggagaucgaggacgagguguuccgcaagcggaaccucaccaucauggaccugcaccccggcuccggcaagacgcgccgguaccugcccgcgauccuccgcgaggccaucaagcggaagcugcgcacccugguccucgccccgacccgcgugguggccagcgagauggcggaggcccugaaggggaugcccauccgguaccagaccacggccgucaaguccgagcacaccggcaaggagaucguggaccugaugugccacgccaccuucaccaugcgccuccugagccccgugcggguccccaacuacaacaugaucaucauggacgaggcccacuucacggacccggcguccaucgccgcccgcggguacaucagcacccgggugggcaugggggaggccgccgcgaucuucaugaccgccacgccgcccggcuccguggaggccuucccccagagcaacgccgucauccaggacgaggagcgcgacaucccggagcgguccuggaacagcggcuacgacuggaucacggacuuccccgggaagaccgugugguucgugcccuccaucaagagcggcaacgacaucgccaacugccugcgcaagaacgggaagcgggucgugcagcucucccgcaagaccuucgacaccgaguaccagaagacgaagaacaacgacugggacuacguggucaccaccgacaucagcgagaugggcgcgaacuuccgggccgaccgcgugaucgacccccggcgcugccugaagccggucauccugaaggacgggcccgagcgggugauccucgccggccccaugcccgugaccgucgccuccgcggcccagcgccggggccgcaucgggcggaacagcaacaaggagggcgaccaguacguguacauggggcagccgcugaacaacgacgaggaccacgcccacuggacggaggccaagaugcugcucgacaacaucaacacccccgagggcaucauccccgcccuguucgagcccgagcgcgagaaguccgcggccaucgacggggaguaccgccugcggggcgaggcccgcaagaccuucguggagcucaugcggcgcggcgaccugccggucuggcugagcuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcccggacguacagcgacccccucgcgcugcgcgaguucaaggaguucgccgccggccggcgcuccgugagcggcgaccugauccucgagaucgggaagcugccccagcaccugacccagaaggcccagaacgcccucgacaaccuggugaugcugcacaacuccgagcagggcgggaaggcguaccggcacgccauggaggagcucccggacaccaucgagacccugaugcugcucgcccugaucgccguccugaccggcggggugacccucuucuuccugagcggccgcggccuggggaagaccuccaucggccuccugugcgugauggcgagcuccgcccugcucuggauggccagcgucgagccccacuggaucgccgccuccaucauccuggaguucuuccugauggugcuccugauccccgagcccgaccggcagcgcaccccgcaggacaaccagcuggcguacguggucaucgggcuccuguucaugauccugaccguggccgccaacgagaugggccuccuggagacgaccaagaaggaccuggggaucggccacgccgccgcggagaaccaccaccacgccgccaugcucgacguggaccugcaccccgccagcgccuggacccuguacgcggucgccaccacgaucaucacccccaugaugcggcacaccaucgagaacaccacggccaacaucucccucaccgccaucgccaaccaggcggccauccugaugggccuggacaagggguggccgaucagcaagauggacaucggcgugccccuccuggcccuggggugcuacucccaggugaacccccucacccugaccgccgcgguccugaugcucguggcccacuacgccaucaucggccccgggcugcaggccaaggccacgcgcgaggcgcagaagcggaccgccgccggcaucaugaagaacccgaccguggacggcaucgucgccaucgaccuggaccccgugguguacgacgccaaguucgagaagcagcucgggcagaucaugcugcugauccucugcaccagccagauccugcugaugcgcacgaccugggcgcucugcgaguccaucacccuggccaccggcccccugacgacccucugggaggggagccccggcaaguucuggaacaccaccaucgccgucuccauggccaacaucuuccgcggcagcuaccuggccggggcgggccuggccuucagccucaugaagucccucgggggcgggcggcgcgggacgggcgcccagggggagacccugggcgagaaguggaagcggcagcucaaccagcugagcaaguccgaguucaacaucuacaagcgcagcgggaucauggagguggaccgguccgaggccaaggagggccugaagcgcggggagaccaccaagcacgcggugagccggggcacggccaagcuccgcugguucgucgagcggaaccuggugaagccggagggcaaggugaucgaccuggggugcggccgcgggggcugguccuacuacugcgccgggcugaagaaggucaccgaggugaagggcuacaccaagggcgggcccggccacgaggagcccgugcccauggccaccuacggguggaaccucgucaagcugcacagcggcaaggacguguucuucacgccgcccgagaagugcgacacccugcucugcgacaucggggaguccagccccaaccccaccaucgaggagggccggacccugcgcgugcugaagauggucgagccguggcuccggggcaaccaguucugcaucaagauccugaaccccuacaugcccuccgugguggagacccuggagcagaugcagcgcaagcacgggggcaugcucguccggaacccccugagccgcaacuccacgcacgagauguacugggugagcugcgggaccggcaacaucguguccgccgucaacaugaccagccggaugcugcucaaccgcuucaccauggcgcaccggaagccgacguacgagaaggacguggaccugggcgccgggacccgccacguggccgucgagcccgagguggccaaccuggacaucaucggccagcgcaucgagaacaucaagaacgagcacaaguccaccuggcacuacgacgaggacaaccccuacaagaccugggccuaccacgggagcuacgaggucaagcccuccggcagcgcgagcuccauggugaacggggugguccggcuccugacgaagccgugggacgugauccccauggugacccagaucgccaugaccgacaccacgcccuucggccagcagcgcgucuucaaggagaagguggacacccggacccccaaggccaagcgcggcaccgcccagaucauggaggugacggccaaguggcuguggggguuccucagccggaacaagaagccgcgcaucugcacccgggaggaguucacccgcaagguccgguccaacgcggccaucggcgccguguucguggacgagaaccaguggaacagcgccaaggaggcggucgaggacgagcgcuucugggaccuggugcaccgggagcgcgagcugcacaagcaggggaagugcgcgaccugcguguacaacaugaugggcaagcgggagaagaagcucggggaguucggcaaggccaagggcucccgcgccaucugguacauguggcugggggcccgguuccuggaguucgaggcgcucggcuucaugaacgaggaccacugguucagccgcgagaacucccugagcggggucgagggcgaggggcugcacaagcucggcuacauccugcgggacaucuccaagauccccggcgggaaccuguacgccgacgacacggccggcugggacacccgcaucaccgaggacgaccuccagaacgaggccaagaucaccgacaucauggagcccgagcacgcccugcuggcgacgagcaucuucaagcucaccuaccagaacaagguggugcggguccagcgcccggccaagaacgggaccgugauggacgugaucucccggcgcgaccagcgcggcagcggccaggucgggaccuacggccugaacacguucaccaacauggaggcccagcugauccggcagauggaguccgaggggaucuucagccccuccgagcucgagacccccaaccuggccaagcgcgugcuggacuggcucgagaagcacggcaucgagcggcugaagcgcauggccaucagcggggacgacugcguggucaagcccaucgacgaccgguucgcgaccgcccugacggcccucaacgacaugggcaaggugcgcaaggacaucccgcagugggagcccuccaagggcuggaacgacuggcagcagguccccuucugcagccaccacuuccaccagcugaucaugaaggacgggcgggagaucgucgugcccugccgcaaccaggacgagcugaucggccgggcccgcgugagccagggggccggcuggucccuccgggagaccgcgugccugggcaagagcuacgcccagauguggcagcugauguacuuccaccgccgggaccuccgccuggccgccaacgcgaucugcuccgccgucccgguggacugggugcccaccagccggaccacgugguccauccacgcccaccaccaguggaugaccaccgaggacaugcugagcgucuggaaccgcguguggaucgaggagaaccccuggauggaggacaagacccacguguccagcugggaggacguccccuaccucggcaagcgggaggaccaguggugcggcucccugaucgggcugaccgcccgcgccacgugggcgagcaacauccagguggccaucaaccaggugcggcgccucaucggcaacgagaacuaccuggacuacaugaccuccaugaagcgcuucaagaacgagagcgacccggagggggcccugugguga

SEQ ID NO: 8886 - RNA, 9879 nt, Artificial Sequence
  derived and/or modified CDS sequence (opt1) from DENV-1__KC762631__SS-prME
agcgugaccaugcugcucaugcugaugcccaccgcccuggccuuccaccucaccacccggggcggggagccccacaugaccgugagcaagcaggagcggggcaagagccugcuguucaagaccuccgccggggugaacaugugcacccucaucgccauggaccugggcgagcugugcgaggacacccucaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcgggucgagacgugggcccugcgccaccccggguucaccgugaucgcccuguuccucgcgcacgccaucggcaccagcaucacccagaaggggaucaucuucauccugcugaugcucgugacgcccuccauggccaugcggugcgucggcaucggcagccgcgacuucguggaggggcuguccggcgccaccuggguggacgucgugcuggagcacgggagcugcgugaccaccauggccaaggacaagcccacgcucgacaucgagcugcugaagaccgaggucaccaaccccgcggugcuccggaagcugugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgcgaccaucacgccccaggcccccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgcgaagaagcaggaggucguggugcugggcagccaggagggcgccaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccacggcccgcggggcccggcgcauggcgauccugggcgacaccgccugggacuucggguccaucggcggcguguucaccagcgucgggaagcucgugcaccagaucuucggcaccgccuacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucacggugguggucggggacguggcgggcauccuggcccaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgcgaacgccagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacgcuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaaccuguuccacaccauguggcacgugacgcgcggcgcggugcugauguaccaggggaagcggcucgagcccagcugggccuccgucaagaaggaccugaucagcuacggcggcggguggcgccugcagggcuccuggaacaccggggaggagguccaggugaucgccgucgagcccggcaagaaccccaagaacgugcagaccgcccccgggaccuucaagacgcccgagggcgaggugggcgccaucgcgcucgacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcugcccgagaucgaggacgagguguuccgcaagcggaaccucaccaucauggaccugcaccccggcagcgggaagacccgccgguaccugccggccaucguccgcgaggccaucaagcggaagcuccgcacccugauccuggcccccacgcgcgugguggccuccgagauggcggaggcccucaagggcaugcccauccgguaccagaccaccgccgucaagagcgagcacaccggcaaggagaucguggaccugaugugccacgccacguucaccaugcgccugcucucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaaccugggguacgaguggaucaccgacuuccccggcaagaccgugugguucgugcccagcaucaaguccggcaacgacaucgccaacugccugcgcaagaacgggaagcgggucauccagcucagccgcaagacguucgacaccgaguaccagaagaccaagaacaacgacugggacuacguggugaccacggacaucuccgagaugggcgcgaacuuccgggccgaccgcgucaucgacccgcggcgcugccugaagcccgugauccugaaggacgggcccgagcgggugauccucgccggccccaugccggucaccguggccagcgccgcgcagcgccgggggcgcgucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccgccugcggggcgaggcccgcaagacguucguggagcucaugcggcgcggggaccugcccguguggcugagcuacaaggucgccuccgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacagcgacccccucgcccugcgcgaguucaaggaguucgcggccggccggcgcuccgucagcggggaccugauccucgagaucggcaagcugccgcagcaccugacccagcgggcccagaacgcccucgacaaccuggugaugcugcacaacuccgagcagggcgggcgcgcguaccggcacgccauggaggagcuccccgagacgaucgagacccugaugcugcucgcccugaucgccgugcugaccggcggggucacccucuucuuccugagcggccgcgggcugggcaagaccuccaucggccuccugugcgugauggccagcuccgugcugcucuggauggcgagcgucgagccccacuggaucgccgccuccaucauccuggaguucuuccugauggugcuccugauccccgagccggaccggcagcgcacgccccaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccagcgcguggacgcuguacgccguggccaccaccaucaucaccccgaugaugcggcacacgaucgagaacaccaccgccaacaucucccucaccgccaucgcgaaccaggccgccauccugauggggcuggacaagggcuggcccaucagcaagauggacaucggcgucccccuccuggcccuggggugcuacucccaggugaacccccucacgcugaccgcggccgugcugaugcucgucgcccacuacgccaucaucggcccggggcugcaggccaaggcgacccgcgaggcccagaagcgcaccgccgccggcaucaugaagaaccccacgguggacgggaucguggccaucgaccuggaccccgucguguacgacgcgaaguucgagaagcagcucggccagaucaugcugcugauccucugcaccagccagauccugcugaugcggaccaccugggcccucugcgaguccaucacgcuggccaccggcccccugaccacccucugggaggggagcccgggcaaguucuggaacacgaccaucgccguguccauggccaacaucuuccgcgggagcuaccuggcgggcgccggccuggccuucucccucaugaagucccucgggggcgggcggcgcgggaccggggcccagggcgagacccugggcgagaaguggaagcggcagcucaaccagcugagcaaguccgaguucaacacguacaagcgcagcgggaucauggaggucgaccgguccgaggcgaaggagggccugaagcgcggggagaccaccaagcacgccgugagccggggcaccgccaagcugcgcugguucguggagcggaaccucgucaagcccgaggggaaggugaucgaccugggcugcggccgcgggggcugguccuacuacugcgccgggcugaagaaggugacggaggucaagggcuacaccaagggcgggcccggccacgaggagcccaucccgauggccaccuacggguggaaccucgugaagcugcacagcggcaaggacguguucuucaucccgcccgagaagugcgacacccugcucugcgacaucggggaguccagccccaacccgacgaucgaggagggccggacccugcgcguccugaagaugguggagcccuggcuccgggggaaccaguucugcaucaagauccugaaccccuacaugcccuccguggucgagacccuggagcagaugcagcgcaagcacggcggcaugcucgugcggaacccgcugagccgcaacuccacccacgagauguacugggugagcugcgggaccggcaacaucgucuccgcggugaacaugacgagccggaugcugcucaaccgcuucaccauggcccaccgcaagcccaccuacgagcgggacguggaccugggggccggcacccgccacgucgccguggagcccgagguggccaaccuggacaucaucggccagcggaucgagaacaucaagcacgagcacaaguccacguggcacuacgacgaggacaaccccuacaagaccugggcguaccacgggagcuacgaggucaagccguccggcagcgccuccagcauggugaacggggucgugaagcuccugaccaagcccugggacgugauccccauggucacccagaucgccaugacggacaccacccccuucggccagcagcgcguguucaaggagaagguggacacccggacgccgaaggccaagcgcgggaccacccagaucauggaggucaccgcccgguggcuguggggcuuccucagccgcaacaagaagccccggaucugcacgcgcgaggaguucacccggaaggugcgcuccaacgcggccaucggcgccguguucgucgacgagaaccaguggaacagcgccaaggaggcgguggaggacgagcgguucugggagcuggugcaccgcgagcgggagcugcacaagcaggggaagugcgcgaccugcgucuacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacgcggaucaccgaggacgaccugcagaacgaggccaagaucaccgacaucauggagccggagcacgcccuccuggcgaaggccaucuucaagcugaccuaccagaacaaggugguccgcgugcagcgccccgccaagaacgggacggugauggacgucaucagccggcgcgaccagcggggcuccggccagguggggaccuacggccucaacaccuucaccaacauggaggcccagcugauccgccagauggagagcgaggggaucuucucccccagcgagcuggagacgcccaaccucgccgagcgggugcuggacuggcuggagaaguacggcgucgagcgccucaagcggauggcgaucuccggggacgacugcguggugaagccgaucgacgaccgcuucgccaccgcccugaccgcccugaacgacaugggcaagguccggaaggacaucccccagugggagcccagcaagggguggaacgacuggcagcagguccccuucugcucccaccacuuccaccagcucaucaugaaggacggccgcgagaucguggucccgugccggaaccaggacgagcuggugggccgcgcccgggugagccagggggcgggcuggucccugcgcgagaccgccugccucggcaagagcuacgcccagauguggcagcugauguacuuccaccggcgcgaccugcggcucgccgcgaacgccaucugcagcgccguccccguggacugggugcccacgucccgcaccaccuggagcauccacgcccaccaccaguggaugaccacggaggacaugcuguccgucuggaaccggguguggaucgaggagaaccccuggauggaggacaagacccacaucagcuccugggaggacgugccguaccugggcaagcgcgaggaccaguggugcgggagccucaucggccugaccgcccgcgcgaccugggccaccaacauccaggucgccaucaaccaggugcggcgccugaucggcaacgagaacuaccucgacuacaugacguccaugaagcgguucaagaacgagagcgaccccgagggggcccugugguga

SEQ ID NO: 8887 - RNA, 9879 nt, Artificial Sequence
  derived and/or modified CDS sequence (opt1) from DENV-1__KC762621__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaccagccagcacaacuaccgccccggguacuucacccagaccgccggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgcgaacgccagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacgcuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacgcgcggcgcgguccugauguaccaggggaagcggcuggagcccagcugggccuccgugaagaaggaccucaucagcuacggcggcggguggcgccugcagggcuccuggaacaccggggaggaggugcaggucaucgccguggagcccggcaagaaccccaagaacgugcagaccgcccccgggaccuucaagacgcccgagggcgaggucggcgccaucgcgcuggacuucaagcccgggaccagcggcucccccaucgugaaccgggaggggaagaucgugggccucuacggcaacggggucgugaccaccagcggcacguacgugagcgccaucgcccaggccaaggcgucccaggaggggccgcugcccgagaucgaggacgaggucuuccgcaagcggaaccugaccaucauggaccuccaccccggcagcgggaagacccgccgguaccugccggccaucgugcgcgaggccaucaagcggaagcugcgcacccucauccuggcccccacgcgcguggucgccuccgagauggcggaggcccugaagggcaugcccauccgguaccagaccaccgccgucaagagcgagcacaccggcaaggagaucguggaccucaugugccacgccacguucaccaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagacguucgacaccgaguaccagaagaccaagaacaacgacugggacuacguggucaccacggacaucagcgagaugggcgcgaacuuccgggccgaccgcgugaucgacccgcggcgcugccugaagcccgugauccucaaggacgggcccgagcgggucauccuggccggccccaugccggugaccgucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagacguucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggaccaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacacgaucgagacccugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucaccguggccgcgaacgagaugggccugcuggagaccaccaagaaggaccucgggaucggcuacgucgccguggagaaccaccaccacgccgccaugcuggacguggaccugcaccccgccuccgcguggacgcucuacgccgucgccaccaccaucaucaccccgaugaugcggcacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcgcaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgucagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggcgaaggagggccucaagcgcggggagaccaccaagcacgccgugucccggggcaccgccaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugacgucccggaugcuccugaaccgcuucaccauggcccaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcccgguggcucuggggcuuccugucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggccaagaucaccgacaucauggagccggagcacgcccugcuggcgaaggccaucuucaagcucaccuaccagaacaaggucgugcgcgugcagcgccccgccaagaacgggacggucauggacgugaucucccggcgcgaccagcggggcagcggccagguggggaccuacggccugaacaccuucaccaacauggaggcccagcugauccgccagauggaguccgaggggaucuucagccccuccgagcucgagacgcccaaccuggccgagcggguccuggacuggcucgagaaguacggcguggagcgccugaagcggauggcgaucagcggggacgacugcguggucaagccgaucgacgaccgcuucgccaccgcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggcgggcuggagccuccgcgagaccgccugccugggcaagagcuacgcccagauguggcagcugauguacuuccaccggcgcgaccuccggcuggccgcgaacgccaucugcuccgccgugcccguggacuggguccccacgagccgcaccaccugguccauccacgcccaccaccaguggaugaccacggaggacaugcugagcguguggaaccggguguggaucgaggagaaccccuggauggaggacaagacccacgucuccagcugggaggacgugccguaccucggcaagcgcgaggaccaguggugcgggucccugaucggccugaccgcccgcgcgaccugggccaccaacauccagguggccaucaaccagguccggcgccucaucggcaacgagaacuaccuggacuacaugacgagcaugaagcgguucaagaacgaguccgaccccgagggggcccugugguga

SEQ ID NO: 8888 - RNA, 9879 nt, Artificial Sequence
  derived and/or modified CDS sequence (opt1) from DENV-1__KC762643__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggggagcugugcgaggacacgcucaccuacaagugcccccgcaucaccgaggccgagcccgacgacguggacugcuggugcaacgccaccgacaccugggugaccuacgggaccugcagccagaccggggagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugauggcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcggccuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgugcucaccagcgucgggaagcuggugcaccagaucuucggcaccgccuacggggugcuguucuccggcgucagcuggaccaugaagaucgggaucggcgugcuccugacguggcugggccucaacucccgcagcaccucccugagcaugaccugcaucgccguggggcuggucacccucuaccugggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcucaagcugcgggacagcuacacccaggugugcgaccaccgccugauguccgccgccaucaaggacagcaaggccgugcacgccgacaugggcuacuggaucgaguccgagaagaacgagaccuggaagcucgcgcgggccagcuucaucgaggucaagaccugcaucuggcccaagucccacacgcuguggagcaacggcgugcuggaguccgagaugaucauccccaagaucuacgggggcccgaccagccagcacaacuaccgccccggguacuucacccagaccgccggccccuggcaccucgggaagcuggagcuggacuucgaccucugcgagggcacgaccguggucguggacgagcacugcggcaaccgggggccgucccugcgcaccaccacggugaccggcaagaucauccacgaguggugcugccggagcugcacccugccgccccugcgcuuccgcggggaggacggcugcugguacgggauggagauccgccccgucaaggagaaggaggagaaccuggugaaguccauggugagcgccggcagcggcgaggucgacuccuucagccuggggcuccugugcaucuccaucaugaucgaggaggugaugcggagccgcuggucccggaagaugcugaugaccggcacgcucgccguguucuuccugcugaucauggggcagcucaccuggaacgaccugauccgccugugcaucauggucggcgcgaacgccagcgaccgcauggggaugggcaccaccuaccucgcccugauggccacguucaagaugcggccgauguucgccgugggccuccucuuccgccggcugaccucccgcgaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccggaaguccuggccccugaacgaggggaucauggccgucggcaucgugagcauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgcgacgacacccugaccauccugcucaaggccacgcugcuggccguguccggcguguacccgcucagcauccccgccacccuguucgucugguacuucuggcagaagaagaagcagcgguccggggugcugugggacacccccagcccgcccgagguggagcgcgccguccuggacgacggcaucuaccggaucaugcagcgcggccuccuggggcggucccaggugggcgugggggucuuccaggagaacguguuccacaccauguggcacgugacgcgcggcgcgguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaaccccaagaacgugcagaccgcccccgggaccuucaagacgcccgagggcgaggucggcgccaucgcgcucgacuucaagcccgggaccagcggcucccccaucgugaaccgggaggggaagaucgugggccuguacggcaacggggucgugaccaccagcggcacguacgugagcgccaucgcccaggccaaggcgucccaggaggggccgcugcccgagaucgaggacgaggucuuccgcaagcggaaccucaccaucauggaccugcaccccggcagcgggaagacccgccgguaccugccggccaucgugcgcgaggccaucaagcggaagcuccgcacccugauccuggcccccacgcgcguggucgccuccgagauggcggaggcccucaagggcaugcccauccgguaccagaccaccgccgucaagagcgagcacaccggcaaggagaucguggaccugaugugccacgccacguucaccaugcgccugcucucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgcgaacuuccgggccgaccgcgugaucgacccgcggcgcugccucaagcccgugauccugaaggacgggcccgagcgggucauccuggccggccccaugccggugaccgucgccuccgccgcgcagcgccgggggcgcgugggccggaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccgccugcggggcgaggcccgcaagacguucguggagcugaugcggcgcggggaccuccccgucuggcuguccuacaagguggccagcgagggcuuccaguacagcgaccggcgcuggugcuucgacggcgagcggaacaaccaggugcuggaggagaacauggacgucgagaucuggaccaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccgcagcaccugacccagcgggcccagaacgcccuggacaaccucgugaugcugcacaacagcgagcagggcgggcgcgcguaccggcacgccauggaggagcugcccgacacgaucgagacccucaugcugcuggcccucaucgccguccugaccggcggggugacccuguucuuccucuccggccgcgggcugggcaagaccagcaucggccugcucugcgugauggccuccagcguccugcuguggauggcguccguggagccccacuggaucgccgccagcaucauccucgaguucuuccugauggugcugcucauccccgagccggaccggcagcgcacgccccaggacaaccagcuggccuacgucgugaucgggcuccucuucaugauccugaccguggccgcgaacgagaugggccugcucgagaccaccaagaaggaccuggggaucggccacgucgccguggagaaccaccaccacgccgccaugcuggacguggaccuccaccccgccuccgcguggacgcuguacgccgucgccaccaccaucaucaccccgaugaugcggcacacgaucgagaacaccaccgccaacaucagccugaccgccaucgcgaaccaggccgccauccucauggggcuggacaagggcuggcccaucuccaagauggacaucggcgugccccugcucgcccuggggugcuacagccaggugaacccccugacgcucaccgcggccguccugaugcugguggcccacuacgccaucaucggcccggggcuccaggccaaggcgacccgcgaggcccagaagcgcaccgccgccggcaucaugaagaaccccacgguggacgggaucgucgccaucgaccuggaccccgugguguacgacgcgaaguucgagaagcagcugggccagaucaugcuccugauccugugcaccucccagauccuccugaugcggaccaccugggcccugugcgagagcaucacgcucgccaccggcccccugaccacccugugggagggguccccgggcaaguucuggaacacgaccaucgccgucagcauggccaacaucuuccgcggguccuaccucgcgggcgccggccuggccuucagccugaugaagucccucgggggcgggcggcgcggcaccggggcccagggcgagacccugggcgagaaguggaagcggcagcugaaccagcucuccaagagcgaguucaacacguacaagcgcuccgggaucauggagguggaccggagcgaggcgaaggagggccugaagcgcggggagaccaccaagcacgccgugucccggggcaccgccaagcugcgcugguucgucgagcggaaccuggugaagcccgaggggaaggugaucgaccucggcugcggccgcgggggcuggagcuacuacugcgccgggcugaagaaggucacggaggugaagggcuacaccaagggcgggcccggccacgaggagcccaucccgauggccaccuacggguggaaccuggugaagcuccacuccggcaaggacgucuucuucaucccgcccgagaagugcgacacccugcugugcgacaucggggagagcucccccaacccgacgaucgaggagggccggacccuccgcgugcugaagaugguggagcccuggcugcgggggaaccaguucugcaucaagauccucaaccccuacaugcccagcgucguggagacccuggagcagaugcagcgcaagcacggcggcaugcuggugcggaacccgcucucccgcaacagcacccacgagauguacugggucuccugcgggaccggcaacaucgugagcgcggugaacaugacgucccggaugcugcugaaccgcuucaccauggcccaccgcaagcccaccuacgagcgggacgucgaccucggggccggcacccgccacguggccguggagcccgaggucgccaaccuggacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggugaagcugcucaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcccgguggcuguggggcuuccugucccgcaacaagaagccccggaucugcacgcgcgaggaguucauccggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacccggaucacggaggacgaccugcagaacgaggccaagaucaccgacaucauggagccggagcacgcccugcucgcgaaggccaucuucaagcugaccuaccagaacaaggucgugcgcgugcagcgccccgccaagaacgggaccgucauggacgugaucucccggcgcgaccagcggggcagcggccagguggggacguacggccugaacaccuucaccaacauggaggcccagcucauccgccagauggaguccgaggggaucuucagccccuccgagcuggagacccccaaccuggccgagcggguccucgacuggcuggagaaguacggcguggagcgccugaagcggauggcgaucagcggggacgacugcguggucaagccgaucgacgaccgcuucgccacggcccucaccgcccugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcccgggucucccagggggcgggcuggagccugcgcgagaccgccugccugggcaagagcuacgcccagauguggcagcucauguacuuccaccggcgcgaccugcggcuggccgcgaacgccaucugcuccgccgugcccguggacuggguccccaccagccgcacgaccugguccauccacgcccaccaccaguggaugaccaccgaggacaugcucagcguguggaaccggguguggaucgaggagaaccccuggauggaggacaaggcccacgucuccagcugggaggacgugccguaccugggcaagcgcgaggaccaguggugcgggucccugaucggccucacggcgcgcgccaccugggccaccaacauccagguggccaucaaccagguccggcgccugaucggcaacgagaacuaccuggacuacaugaccagcaugaagcgguucaagaacgaguccgaccccgagggggcccucugguga

SEQ ID NO: 8889 - RNA, 9879 nt, Artificial Sequence
  derived and/or modified CDS sequence (opt1) from DENV-1__KC762651__SS-prME
agcgugaccaugcuguucaugcuccugcccaccgcccuggccuuccaccucaccacccgcggcggggagccccacaugaucguguccaagcaggagcggggcaagagccugcuguucaagaccuccgccggggugaacaugugcacccucaucgccauggaccugggcgagcugugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccucgcgccccacgugggccuggggcuggagacccgcaccgagaccuggaugagcuccgagggcgccuggaagcagauccagaagguggagacgugggcccuccggcaccccggguucaccgugaucgcccuguuccuggcccacgcgaucggcaccagcaucacccagaaggggaucaucuucauccuccugaugcuggugacgcccuccauggccaugcgcugcgucggcaucggcaaccgggacuucguggaggggcucagcggcgccaccuggguggacgucgugcuggagcacggguccugcgugaccaccauggccaaggacaagcccacgcuggacaucgagcuccugaagaccgaggucaccaaccccgccgugcugcgcaagcucugcaucgaggcgaagaucagcaacaccacgaccgacucccggugccccacccagggcgaggccacccugguggaggagcaggacacgaacuucgucugccgccggaccuucguggaccgcggcugggggaacggcugcgggcuguucggcaaggggagccucaucacgugcgccaaguucaagugcgugaccaagcuggagggcaagaucguccaguacgagaaccugaaguacuccgugaucgugacgguccacaccggcgaccagcaccagguggggaacgagaccaccgagcacggcaccacggccaccaucacgccccaggcccccaccagcgagauccagcucacggacuacggggcgcugacccuggacugcagcccccggaccggccucgacuucaacgagaugguccugcugaccaugaaggagaaguccuggcucgugcacaagcagugguuccuggaccugccgcuccccuggacguccggggccagcaccagccaggagaccuggaaccgccaggaccugcuggugaccuucaagacggcccacgccaagaagcaggaggucguggugcucggcucccaggagggcgccaugcacaccgcgcugaccggggccaccgagauccagacgagcggcaccaccaccaucuucgccgggcaccugaagugccggcucaagauggacaagcugacgcugaagggcgucuccuacgugaugugcaccgggagcuucaagcucgagaaggagguggccgagacccagcacggcaccguccugguccaggugaaguacgagggcacggacgcccccugcaagauccccuucuccagccaggacgagcgcggggucauccagaacggccggcugaucaccgcgaacccgaucgugaccgacaaggagaagcccgugaacaucgaggccgagccgcccuucggggaguccuacaucgucgugggcgccggcgagaaggcccugaagcucagcugguucaagaagggguccagcaucggcaagauguucgaggcgaccgcccgcggggcccggcgcauggccauccugggcgacacggccugggacuucggguccaucggcggcguguucaccagcgucgggaagcuggugcaccagaucuucggcaccgcguacggggugcuguucuccggcgucagcuggaccaugaagaucgggaucggcauccugcugacguggcucggccugaacucccgcagcaccucccugagcaugaccugcaucgccguggggauggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggccgacagcccgaagcgccucuccgccgcgaucggcaaggccugggaggagggggugugcggcauccggagcgccacccgccuggagaacaucauguggaagcagaucuccaacgagcugaaccacauccuccuggagaacgacaugaaguucaccgucguggugggggacgucagcggcauccuggcccaggggaagaagaugauccggccccagcccauggagcacaaguacuccuggaaguccuggggcaaggccaagaucaucggcgcggacgugcagaacacgaccuucaucaucgacgggcccaacaccccggagugccccgacaaccagcgcgccuggaacaucugggagguggaggacuacggcuucggggucuucaccacgaacaucuggcucaagcugcgggacuccuacacccaggugugcgaccaccgccugaugagcgccgccaucaaggacuccaaggcggugcacgccgacaugggcuacuggaucgagagcgagaagaacgagaccuggaagcucgagcgggccuccuucaucgaggucaagaccugcaucuggccccgcagccacacgcugugguccaacggcgugcuggagagcgagaugaucauccccaagaccuacgggggcccggugucccagcacaacuaccggcccggguacuucacccagaccgccggccccuggcaccucgggaagcuggagcuggacuucaaccucugcgagggcacgaccgucgugguggacgagaacugcggcaaccgcgggccgagccugcggaccaccacggucaccggcaagaucauccacgaguggugcugccgcuccugcacccugccgccccuccgguucaagggggaggacggcugcugguacgggauggagauccgccccgugaaggagaaggaggagaaccuggucaagagcauggucagcgccggcuccggcgagguggacagcuucucccuggggcuccugugcaucagcaucaugaucgaggaggugaugcggucccgcuggagcggcaagaugcugaugaccgggacgcucgcggucuuccugcugcucaccaugggccagcugaccuggaacgaccugauccggcucugcaucauggugggggccaacgccuccgacaugaugggcaugggcaccacguaccuggcccugauggccaccuuccgcaugcgcccgauguucgcggucgggcuccuguuccggcgccugaccagccgggaggugcuccugcugaccgugggccucucccuggucgccagcguggagcugcccaacucccucgaggagcugggggacggccuggccaugggcaucaugaugcucaagcugcugacggacuuccagagccaccagcucugggccacccugcugucccucaccuucgugaagaccgccuucagccugcacuacgcguggaagacgauggccaugauccuguccaucgucagccucuucccccugugccuguccaccaccagccagaagaccacguggcuccccgugcugcuggggucccucggcugcaagccgcugaccaugcugcucaucaccgagaacaagaucugggggcgccggagcuggccccugaacgagggcaucauggccaucgggaucgugagcauccugcucuccagccugcugaagaacgacgucccccucgccggcccccugaucgcgggcgggaugcugaucgccugcuacgugaucuccggcagcuccgccgaccucagccuggagaaggccgccgagguguccugggaggacgaggcggagcacagcggggccucccacaacauccuggucgaggugcaggacgacggcaccaugaagaucaaggacgaggagcgcgacgacacccucacgauccugcugaaggccacccuccuggccaucagcgggguguacccgauguccauccccgccacccuguucgucugguacuucuggcagaagaagaagcagcggagcggcgugcucugggacacccccagcccgcccgagguggagcgcgcgguccuggacgacggcaucuaccggauccugcagcgcgggcugcucggccggagccaggugggggugggcgucuuccaggaggggguguuccacacgauguggcacgugacccgcggcgccguccugauguaccagggcaagcggcuggagcccuccugggccagcgugaagaaggaccucaucuccuacgggggcggguggcgcuuccagggcagcuggaacaccggggaggaggugcaggucaucgccguggagcccggcaagaaccccaagaacgugcagaccacgcccggcaccuucaagaccuccgagggggaggucggcgccaucgcgcuggacuucaagcccgggaccagcggcagccccaucgugaaccgggagggcaagaucguggggcuguacggcaacggggucgugacgaccuccggcaccuacgugagcgccaucgcccaggccaaggccucccaggaggggccccucccggagaucgaggacgaggucuuccgcaagcggaaccugaccaucauggaccugcaccccggcagcggcaagacgcgccgguaccuccccgcgauccugcgcgaggccaucaagcggaagcugcgcacccucgugcuggccccgacccgcguggucgccuccgagauggcggaggcccugaaggggaugcccauccgguaccagaccacggccgucaagagcgagcacaccggcaaggagaucguggaccucaugugccacgccaccuucaccaugcgccugcugucccccguccgggugcccaacuacaacaugaucaucauggacgaggcccacuucacggacccggcgagcaucgccgcccgcggguacaucuccacccgggugggcaugggggaggccgccgcgaucuucaugaccgccacgccgcccggcagcgucgaggccuucccccaguccaacgccgugauccaggacgaggagcgcgacaucccggagcggagcuggaacuccggcuacgacuggaucacggacuuccccgggaagaccgugugguucguccccagcaucaaguccggcaacgacaucgccaacugccuccgcaagaacgggaagcggguggugcagcugagccgcaagaccuucgacaccgaguaccagaagacgaagaacaacgacugggacuacgucgugaccaccgacaucuccgagaugggcgcgaacuuccgggccgaccgcgucaucgacccccggcgcugccugaagccggugauccucaaggacgggcccgagcgggugauccuggccggccccaugcccgucaccguggccagcgcggcccagcgccggggccgcaucgggcggaacccgaacaaggagggcgaccaguacguguacauggggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccgccuccggggcgaggcccgcaagaccuucgucgagcugaugcggcgcggcgaccugcccguguggcucagcuacaagguggccagcgagggguuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcgcugcgcgaguucaaggaguucgccgccggccggcgcuccgugagcggcgaccucauccuggagaucgggaagcugccgcagcaccucacccagaaggcccagaacgcccuggacaaccuggucaugcuccacaacuccgagcagggcgggaaggcguaccggcacgccauggaggagcugcccgacaccaucgagacccugaugcuccuggcccugaucgccgugcucaccggcggggugacgcuguucuuccugagcggccgcggccucgggaagaccuccaucggccugcugugcgucauggcgagcuccgcccuccuguggauggccagcguggagccccacuggaucgccgccuccaucauccuggaguucuuccucauggugcugcugauccccgagccggaccggcagcgcacgccccaggacaaccagcucgcguacgucgugaucgggcugcuguucaugauccucaccguggccgccaacgagaugggccugcuggagacgaccaagaaggaccucgggaucggccacgccgccgcggagaaccaccaccacgccgccaugcuggacgucgaccugcaccccgccagcgccuggacccucuacgcgguggccaccacgaucaucaccccgaugaugcggcacaccaucgagaacaccacggccaacaucucccugaccgccaucgccaaccaggcggccauccugaugggccucgacaagggguggcccaucagcaagauggacaucggcgugccccugcuggcccucgggugcuacucccaggucaacccccugacccugaccgccgcggugcucaugcugguggcccacuacgccaucaucggcccggggcugcaggccaaggccacgcgcgaggcgcagaagcggaccgccgccggcaucaugaagaaccccaccgucgacggcaucguggccaucgaccucgaccccguggucuacgacgccaaguucgagaagcagcuggggcagaucaugcugcucauccugugcaccagccagauccugcucaugcgcacgaccugggcgcugugcgaguccaucacccuggccaccggcccccucacgacccugugggaggggagcccgggcaaguucuggaacaccaccaucgccguguccauggccaacaucuuccgcggcagcuaccuggccggggcgggccucgccuucagccugaugaagucccucgggggcgggcggcgcgggacgggcgcccagggggagacccucggcgagaaguggaagcggcagcugaaccagcugagcaaguccgaguucaacaucuacaagcgcagcgggaucauggagguggaccgguccgaggccaaggagggccucaagcgcggggagaccaccaagcacgcggucagccggggcacggccaagcugcgcugguucguggagcggaaccuggugaagcccgagggcaaggucaucgaccuggggugcggccgcgggggcugguccuacuacugcgccgggcucaagaaggugaccgaggugaagggcuacaccaagggcgggcccggccacgaggagcccgucccgauggccaccuacggguggaaccuggugaagcugcacagcggcaaggacguguucuucacgccgcccgagaagugcgacacccuccugugcgacaucggggaguccagccccaacccgaccaucgaggagggccggacccugcgcguccucaagaugguggagcccuggcugcggggcaaccaguucugcaucaagauccugaaccccuacaugcccuccguggucgagacccucgagcagaugcagcgcaagcacgggggcaugcuggugcggaacccgcugagccgcaacuccacgcacgagauguacugggugagcugcgggaccggcaacaucgucuccgccgugaacaugaccagccggaugcuccugaaccgcuucaccauggcgcaccggaagcccacguacgagcgcgacguggaccugggcgccgggacccgccacgucgccguggagcccgaggucgccaaccucgacaucaucggccagcggaucgagaacaucaagaacgagcacaaguccaccuggcacuacgacgaggacaaccccuacaagaccugggccuaccacgggagcuacgaggugaagccguccggcagcgcgagcuccauggugaacggggucgugcgccugcugacgaagcccugggacgugauccccauggucacccagaucgccaugaccgacaccacgcccuucggccagcagcggguguucaaggagaagguggacacccgcaccccgaaggccaagcggggcaccgcccagaucauggaggucacggccaaguggcucuggggguuccugagccgcaacaagaagccccggaucugcacccgcgaggaguucacccggaaggugcgcuccaacgcggccaucggcgccguguucgucgacgagaaccaguggaacagcgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaagggcucccgggccaucugguacauguggcugggggcccgcuuccucgaguucgaggcgcugggcuucaugaacgaggaccacugguucagccgggagaacucccugagcgggguggagggcgaggggcuccacaagcugggcuacauccugcgcgacaucuccaagauccccggcgggaaccucuacgccgacgacacggccggcugggacacccggaucaccgaggacgaccugcagaacgaggccaagaucaccgacaucauggagccggagcacgcccugcucgcgacgagcaucuucaagcugaccuaccagaacaaggugguccgcgugcagcggcccgccaagaacgggaccgugauggacgucaucucccgccgcgaccagcggggcagcggccagguggggaccuacggccugaacacguucaccaacauggaggcccagcucauccgccagauggaguccgaggggaucuucagccccuccgagcuggagacccccaaccuggccaagcgggugcucgacuggcuggagaagcacggcaucgagcgccugaagcggauggccaucagcggggacgacugcgucgugaagccgaucgacgaccgcuucgcgaccgcccucacggcccugaacgacaugggcaaggugcggaaggacaucccccagugggagcccuccaagggcuggaacgacuggcagcagguccccuucugcagccaccacuuccaccagcugaucaugaaggacgggcgcgagaucguggugccgugccggaaccaggacgagcucaucggccgcgcccgggucagccagggggccggcuggucccugcgcgagaccgcgugccugggcaagagcuacgcccagauguggcagcucauguacuuccaccggcgcgaccugcggcuggccgccaacgcgaucugcuccgccgugcccguggacuggguccccaccagccgcaccacgugguccauccacgcccaccaccaguggaugaccaccgaggacaugcucagcguguggaaccggguguggaucgaggagaaccccuggauggaggacaagacccacgucuccagcugggaggacgugccguaccugggcaagcgcgaggaccaguggugcggcucccugaucgggcucaccgcccgggccacgugggcgagcaacauccagguggccaucaaccagguccgccgccugaucggcaacgagaacuaccuggacuacaugaccuccaugaagcgguucaagaacgagagcgaccccgagggggcccucugguga

SEQ ID NO: 8890 - RNA, 9879 nt, Artificial Sequence
  derived and/or modified CDS sequence (opt1) from DENV-1__KC762653__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggggagcucugcgaggacaccaugaccuacaagugcccccggaucaccgagaccgagcccgacgacguggacugcuggugcaacgccaccgagaccugggugaccuacgggaccugcuaccagaccggggagcaccggcgcgacaagcggagcguggcccuggcgccccacgugggccuggggcucgagacccgcaccgagaccuggauguccagcgagggcgccuggcggcagauccagaaggucgagacgugggcccugcgccaccccggguucaccgugaucgcccuguuccucgcccacgcgaucggcaccuccaucacccagaaggggaucaucuucauccugcugaugcucgugacgcccagcauggccaugcggugcgucggcaucggcaaccgcgacuucguggaggggcuguccggcgccaccuggguggacgucgugcuggagcacgggagcugcgugaccaccauggccaaggacaagcccacgcucgacaucgagcugcugaagaccgaggucaccaaccccgccgugcuccggaagcugugcaucgaggcgaagaucuccaacaccacgaccgacagccgcugccccacccagggcgaggccacccugguggaggagcaggacacgaacuucgucugccggcgcaccuucguggaccggggcugggggaacggcugcggccucuucggcaaggggucccugaucacgugcgccaaguucaagugcgugaccaagcuggagggcaagaucguccaguacgagaaccucaaguacagcgugaucgugacgguccacaccggcgaccagcaccagguggggaacgagaccaccgagcacggcaccacggccaccaucacgccccaggcccccaccuccgagauccagcugacggacuacggggcgcugacccucgacugcagcccccgcaccggccuggacuucaacgagaugguccugcucaccaugaaggagaaguccuggcuggugcacaagcagugguuccuggaccucccgcugcccuggacgagcggggccuccaccagccaggagaccuggaaccggcaggaccugcucgugaccuucaagacggcccacgccaagaagcaggaggucguggugcugggcagccaggagggcgccaugcacaccgcgcugaccggggccaccgagauccagacguccggcaccaccaccaucuucgccgggcaccucaagugccgccugaagauggacaagcugacgcucaagggcaugagcuacgucaugugcaccggguccuucaagcuggagaaggagguggccgagacccagcacggcaccgugcugguccaggugaaguacgagggcacggacgcccccugcaagauccccuucagcucccaggacgagaagggggugacccagaacggccggcugaucaccgcgaacccgaucgucaccgacaaggagaagcccgugaacaucgaggccgagccgcccuucggggagagcuaccucguggucggcgccggcgagaaggcccugaagcuguccugguucaagaaggggagcuccaucggcaagauguucgaggcgacggcccgcggggcccggcgcauggccauccucggcgacaccgccugggacuucgggagcaucggcggcguguucaccuccguggggaagcugauccaccagaucuucggcaccgcguacgggguccuguucagcggcguguccuggacgaugaagaucgggaucggcauccuccugaccuggcugggccucaacagccgcuccaccagccuguccaugaccugcaucgccguggggaugaucacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgcgaucggcaaggccugggaggagggggugugcggcauccgguccgccacccgccucgagaacaucauguggaagcagaucagcaacgagcugaaccacauccugcucgagaacgacaugaaguucacggucguggugggggaggucaacggcauccuggcccaggggaagaagaugauccggccccagcccauggagcacaaguacuccuggaaguccuggggcaaggccaaggugaucggcgcggacgugcagaacaccaccuucaucaucgacgggcccaacaccccggagugccccgacaaccagcgcgccuggaacaucugggaggucgaggacuacggcuucgggaucuucacgaccaacaucuggcugaagcuccgggacuccuacacccaggugugcgaccaccgccugaugagcgccgccaucaaggacuccaaggcggugcacgccgacaugggcuacuggaucgagagcgagaagaacgagaccuggaagcuggcccgggccuccuucaucgaggucaagacgugcaucuggcccaagagccacacccucugguccaacggcgugcuggagagcgagaugaucauccccaagaucuacgggggcccgaucucccagcacaacuaccgccccggguacuucacccagaccgccggccccuggcaccuggggaagcucgagcuggacuucgagcugugcgagggcacgaccguggucguggacgagcacugcggcaaccgggggccgagccuccgcaccaccacggugaccggcaagaucauccacgaguggugcugccgguccugcacccugccgccccugcgcuucaagggggaggacggcugcugguacgggauggagauccggcccgucaaggagaaggaggagaaccucgucaagagcaugguguccgcgggcagcggcgaggucgacagcuucucccuggggcugcucugcaucagcaucaugaucgaggaggugaugcgcucccgguggagccgcaagaugcugaugaccggcacgcuggccguguuccuccugcugaccauggggcagcucaccuggaacgaccugauccggcugugcaucauggucggcgccaacgccuccgacaagauggggaugggcaccacguaccucgcccugauggcgaccuuccgcaugcgcccgaugcuggccgugggccuccuguuccggcgccugaccagccgggaggugcuccugcugaccgucgggcucucccugguggccagcgucgagcugcccaacucccucgaggagcugggcgacgggcuggccaugggcaucaugaugcucaagcugcugacggacuuccagagccaccagcucugggccgcgcugcugucccucaccuucgugaagaccacccugagccugcacuacgccuggaagacgauggccaugauccucuccaucgugagccuguucccccugugccucuccaccaccagccagaagaccacguggcugcccguccugcucggcucccuggggugcaagccgcugaccauguuccucaucaccgagaacaagaucuggggccgcaagagcuggccccugaacgaggggaucauggccgugggcaucguguccauccugcucagcagccugcugaagaacgacgucccccucgcggggccccugaucgccggcggcaugcugaucgccugcuacgugaucuccgggagcuccgccgaccucagccuggagaaggccgcggagguguccugggaggaggaggccgagcacagcggcgccucccacaacauccuggucgaggugcaggacgacgggaccaugaagaucaaggacgaggagcgggacgacacccucacgauccugcugaaggccacccuccuggccaucagcggcguguacccgauguccauccccgcgacccuguucgucugguacuucuggcagaagaagaagcagcgcagcggggugcugugggacacccccagcccgcccgagguggagaaggccguccucgacgacggcaucuaccggauccugcagcgcggccugcucggcaagagccaggugggcgugggggucuuccaggagggcguguuccacacgauguggcacgugacccgcggggccguccugauguaccagggcaagcgccuggagcccuccugggccagcgugaagaaggaccucaucuccuacggcgggggcuggcgguuccaggggagcuggaacaccggcgaggaggugcaggucaucgccguggagcccgggaagaaccccaagaacgugcagaccgcgcccggcacguucaagacccccgagggcgaggucggggccaucgcccuggacuucaagcccggcaccuccgggagccccaucgugaaccgcgagggcaagaucgugggccuguacgggaacggcgucgugaccacguccgggaccuacgugagcgccaucgcccaggcgaaggccagccaggagggcccgcuccccgagaucgaggacgaggucuuccggaagcgcaaccugaccaucauggaccugcaccccggguccggcaagacccggcgcuaccucccggccaucgugcgggaggccaucaagcgcaagcugcggacgcuggugcucgcgcccacccgcgucguggccagcgagauggccgaggcccugaagggcaugcccauccgguaccagaccaccgccgugaaguccgagcacacggggaaggagaucgucgaccugaugugccacgcgaccuucaccaugcgccuccugagccccgugcgcgugccgaacuacaacaugaucaucauggacgaggcccacuucaccgaccccgccuccaucgccgcccggggcuacaucagcacgcgcgucgggaugggcgaggcggccgccaucuucaugaccgccacgccgcccggguccauggaggccuucccgcagagcaacgcggccauccaggacgaggagcgggacauccccgagcgcuccuggaacagcggcuacgacuggaucaccgacuuccccggcaagacggugugguucgugcccuccaucaagagcgggaacgacaucgccaacugccugcggaagaacggcaagcgcgucauccagcucucccggaagaccuucgacaccgaguaccagaagaccaagaacaacgacugggacuacguggugacgaccgacaucagcgagaugggggccaacuuccgcgcggaccgggucaucgacccgcgccggugccugaagcccgugauccugaaggacggccccgagcgcgugauccucgccgggcccaugccggucaccguggccuccgccgcccagcggcgcggccggaucggccgcaaccagaacaaggagggggaccaguacaucuacaugggccagccccugaacaacgacgaggaccacgcgcacuggaccgaggccaagaugcugcucgacaacaucaacacgcccgaggggaucauccccgcccuguucgagccggagcgggagaaguccgccgccaucgacggcgaguaccgccugcgcggggaggcgcgcaagaccuucgucgagcucaugcgccggggcgaccugcccguguggcuguccuacaagguggccagcgagggcuuccaguacuccgaccgccgguggugcuucgacggggagcgcaacaaccagguccucgaggagaacauggacguggagaucuggaccaaggagggcgagcggaagaagcugcgcccccgguggcuggacgcccgcaccuacagcgacccccucgcccugcgggaguucaaggaguucgccgcggggcgccggagcguguccggcgaccugauccucgagaucggcaagcugccgcagcaccugacgcagcgcgcccagaacgcccucgacaaccuggucaugcugcacaacagcgagcagggcgggaaggccuaccggcacgcgauggaggagcuccccgacaccaucgagacccugaugcugcucgcccugaucgccgugcugaccgggggcgugacccucuucuuccuguccgggcgcggccugggcaagacgagcaucgggcuccugugcgucauggccuccagcgcccugcucuggauggcguccguggagccccacuggaucgccgccagcaucauccuggaguucuuccugauggugcuccugauccccgagccggaccggcagcgcacgccccaggacaaccagcuggccuacgucgugaucggccuccuguucaugauccugaccguggccgcgaacgagauggggcuccuggagaccacgaagaaggaccugggcaucgggcacgccgccgccgagaaccaccaccacgccgcgaugcucgacgucgaccugcaccccgccuccgccuggacccuguacgccguggccaccaccaucaucacgccgaugaugcggcacaccaucgagaacaccaccgcgaacaucagccucacggccaucgccaaccaggccgcgauccugaugggccuggacaagggcuggcccaucuccaagauggacaucggggugccccuccuggcccugggcugcuacagccaggucaacccccucacccugaccgccgccgugcugaugcucguggcccacuacgcgaucaucgggccgggccugcaggccaaggccacccgcgaggcccagaagcggacggccgcggggaucaugaagaaccccaccgucgacggcaucguggccaucgaccuggaccccguggucuacgacgccaaguucgagaagcagcucggccagaucaugcugcugauccucugcaccucccagauccugcugaugcgcaccacgugggcccucugcgagagcaucacccuggccaccgggccccugaccacgcucugggagggcuccccggggaaguucuggaacaccaccaucgcggugagcauggccaacaucuuccggggcuccuaccuggccggcgccgggcuggcguucagccucaugaagucccugggcgggggccgccgcgggaccggcgcccagggcgagacgcugggggagaaguggaagcggcagcucaaccagcugagcaagagcgaguucaacaccuacaagcgcuccggcaucauggagguggaccggagcgaggccaaggaggggcugaagcgcggcgagaccaccaagcacgccgucucccgggggacggccaagcugcgcugguucguggagcggaaccucgugaagcccgagggcaaggucaucgaccugggcugcgggcgcggcggguggagcuacuacugcgcgggccugaagaaggugaccgaggugaagggguacaccaagggcggccccgggcacgaggagcccaucccgauggccaccuacggcuggaaccucgucaagcugcacuccgggaaggacguguucuucacgccgcccgagaagugcgacacccugcucugcgacaucggcgagagcucccccaacccgaccaucgaggaggggcggacccugcgcgugcugaagauggucgagcccuggcuccggggcaaccaguucugcaucaaggugcugaaccccuacaugcccagcgugaucgagacccuggagcagaugcagcgcaagcacggcgggaugcucguccggaacccgcugucccgcaacagcacgcacgagauguacuggguguccugcggcaccgggaacaucgugagcgccgucaacaugaccucccggaugcugcucaaccgcuucaccauggcccaccggaagcccacguacgagcgcgacguggaccugggcgccggcacccggcacguggcggucgagcccgagguggccaaccuggacaucaucgggcagcgcaucgagaacaucaagaacgagcacaagagcaccuggcacuacgacgaggacaaccccuacaagaccugggccuaccacggcuccuacgaggugaagccgagcggguccgccagcuccauggucaacggcguggugcgccuccugacgaagcccugggacgucauccccauggugacccagaucgccaugaccgacaccacgcccuucgggcagcagcgggucuucaaggagaagguggacacccgcaccccgaaggcgaagcggggcaccgcccagaucauggaggugacggcccgcuggcuguggggcuuccucagccggaacaagaagccccgcaucugcacccgggaggaguucacccgcaagguccggagcaacgccgcgaucggggccguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcagccgcgccaucugguacauguggcugggcgcccgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacacggcggggugggacacccgcaucaccgaggacgaccugcagaacgaggccaagaucaccgacaucauggagccggagcacgcccuccuggccacguccaucuucaagcugaccuaccagaacaagguggugcggguccagcgccccgccaagaacggcaccgugauggacgugaucagccggcgcgaccagcgcggguccggccaggucggcaccuacgggcucaacacguucaccaacauggaggcgcagcugauccggcagauggagagcgagggcaucuucacccccuccgagcuggagacccccaaccucgccgagcgcgugcuggacuggcuggagaagcacgggaucgagcggcucaagcgcauggccaucagcggcgacgacugcguggucaagccgaucgacgaccgguucgccacggcccugaccgcgcugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagaccgccugccucggcaaguccuacgcgcagauguggcagcugauguacuuccaccgccgggaccugcgccucgccgccaacgccaucugcagcgccgugcccguggacuggguccccaccagccggacgaccugguccauccacgcgcaccaccaguggaugaccaccgaggacaugcugagcguguggaaccgcguguggaucgaggagaaccccuggauggaggacaagacccacgucuccagcugggaggacgugccguaccuggggaagcgggaggaccaguggugcggcucccucaucggccugacggcccgcgccaccugggccaccaacauccagguggccaucaaccagguccggcgccugaucgggaacgagaacuaccucgacuacaugaccagcaugaagcgcuucaagaacgaguccgaccccgagggcgcgcugugguga

SEQ ID NO: 8891 - RNA, 9879 nt, Artificial Sequence
  derived and/or modified CDS sequence (opt1) from DENV-1__KC762640__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccuggcgccccacgugggccuggggcucgagacccgcaccgagaccuggaugagcuccgagggcgcguggcggcagauccagaagguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgugggcaucggcaaccgcgacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacacgaacuucgucugccggcgcaccuucguggaccggggcugggggaacggcugcggccuguucggcaaggggagccugaucacgugcgccaaguucaagugcgugaccaagcuggagggcaagaucguccaguacgagaaccucaaguacuccgugaucgugacgguccacaccggcgaccagcaccagguggggaacgagaccaccgagcacggcaccacggccaccaucacgccccaggcccccaccagcgagauccagcugacggacuacggggcgcugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcccacgccaagaagcaggaggucguggugcugggcucccaggagggcgccaugcacaccgcgcugaccggggccaccgagauccagacgagcggcaccaccaccaucuucgccgggcaccucaagugccgccugaagauggacaagcugacgcucaagggcgucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcugaucaccgcgaacccgaucgugaccgacaaggagaagcccgugaacaucgaggccgagccgcccuucggggaguccuaccucgucgugggcgccggcgagaaggcccugaagcugagcugguucaagaagggguccagcaucggcaagauguucgaggcgacggcccgcggggcccggcgcauggccauccucggcgacaccgccugggacuucggguccaucggcggcguguucaccagcgucgggaagcugauccaccagaucuucggcaccgcguacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccuguccgccgcgaucggcaaggccugggaggagggggugugcggcauccggagcgccacccgccucgagaacaucauguggaagcagaucuccaacgagcugaaccacauccugcucgagaacgacaugaaguucacgguggucgugggggaggugaacggcauccuggcccaggggaagaagaugauccggccccagcccauggagcacaaguacagcuggaaguccuggggcaaggccaaggucaucggcgcggacgugcagaacaccaccuucaucaucgacgggcccaacaccccggagugccccgacaaccagcgcgccuggaacaucugggagguggaggacuacggcuucgggaucuucacgaccaacaucuggcugaagcuccgggacagcuacacccaggucugcgaccaccgccugauguccgccgccaucaaggacagcaaggcggugcacgccgacaugggcuacuggaucgaguccgagaagaacgagaccuggaagcuggcccgggccagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgagcugugcgagggcacgaccgugguggucgacgagcacugcggcaaccgggggccgucccuccgcaccaccacggugaccggcaagaucauccacgaguggugcugccggagcugcacccugccgccccugcgcuucaagggggaggacggcugcugguacgggauggagauccggcccgugaaggagaaggaggagaaccucgucaaguccauggugagcgcgggcagcggcgagguggacuccuucagccuggggcugcucugcaucuccaucaugaucgaggaggucaugcgcagccgguggucccgcaagaugcugaugaccggcacgcuggccguguuccuccugcugaccauggggcagcucaccuggaacgaccugauccggcugugcaucauggugggcgccaacgccagcgacaagauggggaugggcaccacguaccucgcccugauggccaccuuccgcaugcgcccgauguucgccgucgggcuccuguuccggcgccugaccucccgggaggugcugcuccugaccgucgggcugagccucguggccuccguggagcugcccaacagccuggaggagcucggcgacgggcuggccaugggcaucaugaugcugaagcuccugacggacuuccagucccaccagcugugggccgcgcuccugagccugaccuucgucaagaccacccucucccugcacuacgccuggaagacgauggccaugauccugagcaucgugucccucuucccccugugccugagcaccaccucccagaagaccacguggcuccccgugcugcugggcagccucgggugcaagccgcugaccauguuccugaucaccgagaacaagaucuggggccgcaaguccuggccccucaacgaggggaucauggccgucggcaucgugagcauccugcugagcucccuccugaagaacgacgugccccuggcggggccccucaucgccggcggcaugcugaucgccugcuacgucaucagcggguccagcgccgaccugucccucgagaaggccgcggaggugagcugggaggaggaggccgagcacuccggcgccagccacaacauccugguggagguccaggacgacgggaccaugaagaucaaggacgaggagcgggacgacacccugacgauccuccugaaggccacccugcucgccaucuccggcguguacccgaugagcauccccgcgacccuguucgugugguacuucuggcagaagaagaagcagcgcuccgggguccugugggacacccccagcccgcccgagguggagaaggccgugcuggacgacggcaucuaccggauccuccagcgcggccugcuggggaagucccaggucggcguggggguguuccaggagggcgucuuccacacgauguggcacgugacccgcggggccgugcucauguaccagggcaagcgccuggagcccagcugggccuccgucaagaaggaccugaucagcuacggcgggggcuggcgguuccagggguccuggaacaccggcgaggagguccaggugaucgccgucgagcccgggaagaaccccaagaacgugcagaccgcgcccggcacguucaagacccccgagggcgaggugggggccaucgcccucgacuucaagcccggcaccagcgggucccccaucgucaaccgcgagggcaagaucgugggccuguacgggaacggcguggucaccacgagcgggaccuacgugagcgccaucgcccaggcgaaggccucccaggagggcccgcugcccgagaucgaggacgagguguuccggaagcgcaaccucaccaucauggaccugcaccccgggagcggcaagacccggcgcuaccugccggccaucguccgggaggccaucaagcgcaagcuccggacgcuggugcuggcgcccacccgcguggucgccuccgagauggccgaggcccucaagggcaugcccauccgguaccagaccaccgccgucaagagcgagcacacggggaaggagaucguggaccugaugugccacgcgaccuucaccaugcgccugcucucccccguccgcgugccgaacuacaacaugaucaucauggacgaggcccacuucaccgaccccgccagcaucgccgcccggggcuacaucuccacgcgcguggggaugggcgaggcggccgccaucuucaugaccgccacgccgcccgggagcauggaggccuucccgcaguccaacgcggccauccaggacgaggagcgggacauccccgagcgcagcuggaacuccggcuacgacuggaucaccgacuuccccggcaagacggucugguucgugcccagcaucaaguccgggaacgacaucgccaacugccugcggaagaacggcaagcgcgugauccagcugagccggaagaccuucgacaccgaguaccagaagaccaagaacaacgacugggacuacgucgugacgaccgacaucuccgagaugggggccaacuuccgcgcggaccgggugaucgacccgcgccggugccucaagcccgucauccugaaggacggccccgagcgcgugauccuggccgggcccaugccggucaccguggccagcgccgcccagcggcgcggccggaucggccgcaaccagaacaaggagggggaccaguacaucuacaugggccagccccucaacaacgacgaggaccacgcgcacuggaccgaggccaagaugcugcuggacaacaucaacacgcccgaggggaucauccccgcccucuucgagccggagcgggagaaguccgccgccaucgacggcgaguaccgccugcgcggggaggcgcgcaagaccuucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacagcgacccccuggcccuccgggaguucaaggaguucgccgcggggcgccgguccgugagcggcgaccugauccuggagaucggcaagcucccgcagcaccugacgcagcgcgcccagaacgcccuggacaaccucgugaugcugcacaacuccgagcagggcgggaaggccuaccggcacgcgauggaggagcugcccgacaccaucgagacccucaugcugcuggcccucaucgccguccugaccgggggcgugacccuguucuuccucagcgggcgcggccugggcaagacguccaucgggcugcucugcgugauggccagcuccgcccugcuguggauggcgagcgucgagccccacuggaucgccgccuccaucauccucgaguucuuccugauggugcugcucauccccgagccggaccggcagcgcacgccccaggacaaccagcuggccuacguggucaucggccuccucuucaugauccugaccguggccgcgaacgagauggggcugcucgagaccacgaagaaggaccugggcaucgggcacgccgccgccgagaaccaccaccacgccgcgaugcuggacguggaccuccaccccgccagcgccuggacccuguacgccgucgccaccaccaucaucacgccgaugaugcggcacaccaucgagaacaccaccgcgaacaucucccugacggccaucgccaaccaggccgcgauccucaugggccuggacaagggcuggcccaucagcaagauggacaucggggugccccugcucgcccugggcugcuacucccaggugaacccccugacccucaccgccgccguccugaugcugguggcccacuacgcgaucaucgggccgggccuccaggccaaggccacccgcgaggcccagaagcggacggccgcggggaucaugaagaaccccaccguggacggcaucgucgccaucgaccuggaccccgugguguacgacgccaaguucgagaagcagcugggccagaucaugcuccugauccugugcaccagccagauccuccugaugcgcaccacgugggcccugugcgaguccaucacccucgccaccgggccccugaccacgcugugggagggcagcccggggaaguucuggaacaccaccaucgcggucuccauggccaacaucuuccggggcagcuaccucgccggcgccgggcuggcguucucccugaugaagucccucggcgggggccgccgcgggaccggcgcccagggcgagacgcugggggagaaguggaagcggcagcugaaccagcucagcaaguccgaguucaacaccuacaagcgcagcggcaucauggagguggaccgguccgaggccaaggaggggcugaagcgcggcgagaccaccaagcacgccgugagccgggggacggccaagcugcgcugguucgucgagcggaaccuggugaagcccgagggcaaggugaucgaccucggcugcgggcgcggcgggugguccuacuacugcgcgggccugaagaaggucaccgaggugaagggguacaccaagggcggccccgggcacgaggagcccaucccgauggccaccuacggcuggaaccuggugaagcucuacagcgggaaggacgucuucuucacgccgcccgagaagugcgacacccugcugugcgacaucggcgaguccagccccaacccgaccaucgaggaggggcggacccuccgcgugcugcggaugguggagcccuggcugcgcggcaaccaguucugcaucaagguccucaaccccuacaugcccuccgugaucgagacccuggagcagaugcagcggaagcacggcgggaugcuggugcgcaacccgcucagccggaacuccacgcacgagauguacugggucagcugcggcaccgggaacaucguguccgccgugaacaugaccagccgcaugcugcugaaccgguucaccauggcccaccgcaagcccacguacgagcgggacgucgaccucggcgccggcacccgccacguggcgguggagcccgaggucgccaaccuggagaucaucgggcagcgcaucgagaacaucaagaacgagcacaaguccaccuggcacuacgacgaggacaaccccuacaagaccugggccuaccacggcagcuacgaggugaagccguccgggagcgccuccagcauggugaacggcgucgugcggcugcucacgaagcccugggacgucauccccauggugacccagaucgccaugaccgacaccacgcccuucgggcagcagcgcguguucaaggagaaggucgacacccggaccccgaaggcgaagcgcggcaccgcccagaucauggaggugacggcccgguggcuguggggcuuccugagccgcaacaagaagccccggaucugcacccgcgaggaguucacccggaaggugcgcuccaacgccgcgaucggggccgucuucguggacgagaaccaguggaacagcgccaaggaggccguggaggacgagcgguucugggaccucguccaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacacggcggggugggacacccggaucaccgaggacgaccugcagaacgaggccaagaucaccgacaucauggagccggagcacgcccugcucgccacgagcaucuucaagcugaccuaccagaacaaggucgugcgcgugcagcggcccgccaagaacggcaccgucauggacgugaucucccgccgcgaccagcgggggagcggccaggugggcaccuacgggcugaacacguucaccaacauggaggcgcagcucauccgccagauggaguccgagggcaucuucacccccagcgagcuggagacccccaaccuggccgagcggguccucgacuggcuggagaagcacgggaucgagcgccugaagcggauggccaucuccggcgacgacugcguggugaagccgaucgacgaccgcuucgccacggcccucaccgcgcugaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcagcgccguccccguggacugggugcccaccucccgcacgaccuggagcauccacgcgcaccaccaguggaugaccaccgaggacaugcucuccgucuggaaccggguguggaucgaggagaaccccuggauggaggacaagacccacgugagcuccugggaggacgucccguaccuggggaagcgcgaggaccaguggugcggcagccugaucggccucacggcccgggccaccugggccaccaacauccagguggccaucaaccaggugcgccgccugaucgggaacgagaacuaccuggacuacaugaccuccaugaagcgguucaagaacgagagcgaccccgagggcgcgcucugguga
